US010669542B2

(12) United States Patent
Grabczyk et al.

(10) Patent No.: US 10,669,542 B2
(45) Date of Patent: Jun. 2, 2020

(54) COMPOSITIONS AND USES FOR TREATMENT THEREOF

(71) Applicant: BOARD OF SUPERVISORS OF LOUISIANA STATE UNIVERSITY AND AGRICULTURAL AND MECHANICAL COLLEGE, Baton Rouge, LA (US)

(72) Inventors: Edward L. Grabczyk, New Orleans, LA (US); Kayla T. Fuselier, Hammond, LA (US)

(73) Assignee: Board of Supervisors of Louisiana State University and Agricultural and Mechanical College, Baton Rouge, LA (US)

( * ) Notice: Subject to any disclaimer, the term of this patent is extended or adjusted under 35 U.S.C. 154(b) by 336 days.

(21) Appl. No.: 15/345,058

(22) Filed: Nov. 7, 2016

(65) Prior Publication Data
US 2017/0183655 A1 Jun. 29, 2017

Related U.S. Application Data

(63) Continuation-in-part of application No. PCT/US2015/029724, filed on May 7, 2015.

(60) Provisional application No. 61/989,898, filed on May 17, 2014.

(51) Int. Cl.
| C12N 15/11 | (2006.01) |
| A61K 48/00 | (2006.01) |
| C07H 21/02 | (2006.01) |
| C07H 21/04 | (2006.01) |
| C12N 15/113 | (2010.01) |

(52) U.S. Cl.
CPC ........ *C12N 15/113* (2013.01); *C12N 2310/11* (2013.01); *C12N 2320/33* (2013.01)

(58) Field of Classification Search
CPC .............. C12N 15/113; C12N 2310/11; C12N 2320/33; C12N 15/1138
See application file for complete search history.

(56) References Cited

U.S. PATENT DOCUMENTS

| 4,426,330 A | 1/1984 | Sears |
| 4,534,899 A | 8/1985 | Sears |
| 4,587,044 A | 5/1986 | Miller et al. |
| 4,605,735 A | 8/1986 | Miyoshi et al. |
| 4,667,025 A | 5/1987 | Miyoshi et al. |
| 4,762,779 A | 8/1988 | Snitman |
| 4,789,737 A | 12/1988 | Miyoshi et al. |
| 4,824,941 A | 4/1989 | Gordon et al. |

(Continued)

FOREIGN PATENT DOCUMENTS

| EP | 1191097 | 3/2002 | | |
| WO | WO-2004094636 A1 * | 11/2004 | ........... | C12N 15/111 |
| WO | WO-2005109001 A2 * | 11/2005 | ............... | C12Q 1/25 |

OTHER PUBLICATIONS

Grabowski et al. (Genetic Testing, 2005 vol. 9, No. 2:138-146).*

(Continued)

*Primary Examiner* — Terra C Gibbs
(74) *Attorney, Agent, or Firm* — Baker Donelson

(57) ABSTRACT

The invention is directed generally to oligonucleotide compositions for the treatment of DNA repeat expansion diseases. The invention also relates to oligonucleotides directed to subunits of the DNA mismatch repair system.

15 Claims, 18 Drawing Sheets

Specification includes a Sequence Listing.

(56) References Cited

U.S. PATENT DOCUMENTS

| | | |
|---|---|---|
| 4,828,979 A | 5/1989 | Klevan et al. |
| 4,835,263 A | 5/1989 | Nguyen et al. |
| 4,876,335 A | 10/1989 | Yamane et al. |
| 4,904,582 A | 2/1990 | Tullis |
| 4,948,882 A | 8/1990 | Ruth |
| 4,958,013 A | 9/1990 | Letsinger |
| 5,013,556 A | 5/1991 | Woodle et al. |
| 5,034,506 A | 7/1991 | Summerton et al. |
| 5,082,830 A | 1/1992 | Brakel et al. |
| 5,108,921 A | 4/1992 | Low et al. |
| 5,109,124 A | 4/1992 | Ramachandran et al. |
| 5,112,963 A | 5/1992 | Pieles et al. |
| 5,118,802 A | 6/1992 | Smith et al. |
| 5,138,045 A | 8/1992 | Cook et al. |
| 5,213,804 A | 5/1993 | Martin et al. |
| 5,214,136 A | 5/1993 | Lin et al. |
| 5,218,105 A | 6/1993 | Cook et al. |
| 5,227,170 A | 7/1993 | Sullivan |
| 5,245,022 A | 9/1993 | Weis et al. |
| 5,254,469 A | 10/1993 | Warren, III et al. |
| 5,258,506 A | 11/1993 | Urdea et al. |
| 5,262,536 A | 11/1993 | Hobbs, Jr. |
| 5,264,221 A | 11/1993 | Tagawa et al. |
| 5,272,250 A | 12/1993 | Spielvogel et al. |
| 5,292,873 A | 3/1994 | Rokita et al. |
| 5,317,098 A | 5/1994 | Shizuya et al. |
| 5,354,844 A | 10/1994 | Beug et al. |
| 5,356,633 A | 10/1994 | Woodle et al. |
| 5,371,241 A | 12/1994 | Brush |
| 5,391,723 A | 2/1995 | Priest |
| 5,395,619 A | 3/1995 | Zalipsky et al. |
| 5,414,077 A | 5/1995 | Lin et al. |
| 5,416,016 A | 5/1995 | Low et al. |
| 5,416,203 A | 5/1995 | Letsinger |
| 5,417,978 A | 5/1995 | Tari et al. |
| 5,451,463 A | 9/1995 | Nelson et al. |
| 5,459,127 A | 10/1995 | Felgner et al. |
| 5,459,255 A | 10/1995 | Cook et al. |
| 5,459,854 A | 10/1995 | Sherer et al. |
| 5,462,854 A | 10/1995 | Coassin et al. |
| 5,486,603 A | 1/1996 | Buhr |
| 5,510,475 A | 4/1996 | Agrawal et al. |
| 5,512,295 A | 4/1996 | Kornberg et al. |
| 5,512,439 A | 4/1996 | Hornes et al. |
| 5,512,667 A | 4/1996 | Reed et al. |
| 5,514,785 A | 5/1996 | Van Ness et al. |
| 5,521,291 A | 5/1996 | Curiel et al. |
| 5,525,465 A | 6/1996 | Haralambidis et al. |
| 5,527,528 A | 6/1996 | Allen et al. |
| 5,534,259 A | 7/1996 | Zalipsky et al. |
| 5,541,313 A | 7/1996 | Ruth |
| 5,543,152 A | 8/1996 | Webb et al. |
| 5,543,165 A | 8/1996 | Hill |
| 5,545,730 A | 8/1996 | Urdea |
| 5,547,932 A | 8/1996 | Curiel et al. |
| 5,552,538 A | 9/1996 | Urdea et al. |
| 5,556,948 A | 9/1996 | Tagawa et al. |
| 5,565,552 A | 10/1996 | Magda et al. |
| 5,567,810 A | 10/1996 | Weis |
| 5,574,142 A | 11/1996 | Meyer, Jr. et al. |
| 5,578,717 A | 11/1996 | Urdea et al. |
| 5,578,718 A | 11/1996 | Cook et al. |
| 5,580,575 A | 12/1996 | Unger et al. |
| 5,580,731 A | 12/1996 | Chang et al. |
| 5,583,020 A | 12/1996 | Sullivan |
| 5,585,481 A | 12/1996 | Arnold, Jr. et al. |
| 5,587,371 A | 12/1996 | Sessler et al. |
| 5,591,584 A | 1/1997 | Chang et al. |
| 5,591,721 A | 1/1997 | Agrawal et al. |
| 5,595,726 A | 1/1997 | Magda et al. |
| 5,595,756 A | 1/1997 | Bally et al. |
| 5,597,696 A | 1/1997 | Linn et al. |
| 5,599,923 A | 2/1997 | Sessler et al. |
| 5,599,928 A | 2/1997 | Hemmi et al. |
| 5,608,046 A | 3/1997 | Cook et al. |
| 5,688,941 A | 11/1997 | Cook et al. |
| 6,153,737 A | 11/2000 | Manoharan et al. |
| 6,287,860 B1 | 9/2001 | Monia |
| 6,632,427 B1 | 10/2003 | Finiels et al. |
| 6,756,523 B1 | 6/2004 | Kahn et al. |
| 6,783,931 B1 | 8/2004 | Cook et al. |
| 7,563,884 B2 | 7/2009 | Cowsert et al. |
| 7,622,455 B2 | 11/2009 | Bennett et al. |
| 8,361,979 B2 | 1/2013 | Aartsma-Rus et al. |
| 8,455,634 B2 | 6/2013 | Wilton et al. |
| 2002/0068709 A1 | 6/2002 | Orum et al. |
| 2008/0200409 A1 | 8/2008 | Wilton et al. |
| 2014/0039037 A1 | 2/2014 | Van Roon-Mom et al. |

OTHER PUBLICATIONS

Halabi et al. (Nucleic Acids Research, 2018 vol. 46:4022-4032).*

Toulmé, Jean-Jacques. "New candidates for true antisense." Nature Biotechnology 19.1 (2001): 17-18.

Anjomani Virmouni, S., Sandi, C., Al-Mandawi, S. and Pook, M.A. (2014) Cellular, Molecular and Functional Characterisation of YAC Transgenic Mouse Models of Friedreich Ataxia. PloS one, 9, e107416.

Banerjee, A., Sammarco, M.C., Ditch, S., Wang, J. and Grabczyk, E. (2009) A novel tandem reporter quantities RNA polymerase II termination in mammalian cells. PloS one, 4, e6193.

Balzer, M.A. and Deininger, P.L (2002) Alu repeats and human genomic diversity. Nature reviews. Genetics, 3, 370-379.

BioMarin buys Prosensa for up to $840M, shoots for quick OK of Duchenne drug. FierceBiotech, Nov. 24, 2014.

Calmels, N., Seznec, H., Villa, P., Reutenauer, L., Hibert, M., Haiech, J., Rustin, P., Koenig, M. and Puccio, H. (2009) Limitations in a frataxin knockdown cell model for Friedreich ataxia in a high-throughput drug screen. BMC Neurol, 9, 46.

Campuzano, V., Montermini, L., Molto, M.D., Pianese, L., Cossee, M., Cavalcanti, F., Monros, E., Rodius, F., Duclos, F., Monticelli, A. et al. (1996) Friedreich's ataxia: autosomal recessive disease caused by an intronic GAA triplet repeat expansion. Science, 271, 1423-1427.

Cannavo, E., Marra, G., Sabates-Bellver, J., Menigatti, M., Lipkin, S.M., Fischer, F., Cejka, P. and Jiricny, J. (2005) Expression of the MutL homologue hMLH3 in human cells and its role in DNA mismatch repair. Cancer Res, 65, 10759-10766.

Chauhan, C., Dash, D., Grover, D., Rajamani, J. and Mukerji, M. (2002) Origin and instability of GAA repeats: insights from Alu elements. J Biomol Struct Dyn, 20, 253-263.

Chen, P.C., Dudley, S., Hagen, W., Dizon, D., Paxton, L., Reichow, D., Yoon, S.R., Yang, K., Arnheim, N., Liskay, R. M. et al. (2005) Contributions by MutL homologues Mlh3 and Pms2 to DNA mismatch repair and tumor suppression in the mouse. Cancer Res, 65, 8662-8670.

Chen, P.C., Kuraguchi, M., Velasquez, J., Wang, Y., Yang, K., Edwards, R., Gillen, D., Edelmann, W., Kucherlapati, R. and Lipkin, S.M. (2008) Novel roles for MLH3 deficiency and TLE6-like amplification in DNA mismatch repair-deficient gastrointestinal tumorigenesis and progression. PLoS genetics, 4, e1000092.

Cirak, S., Arechavala-Gomeza, V., Guglieri, M., Feng, L., Torelli, S., Anthony, K., Abbs, S., Garralda, M.E., Bourke, J., Wells, D.J. et al. (2011) Exon skipping and dystrophin restoration in patients with Duchenne muscular dystrophy after systemic phosphorodiamidate morpholino oligomer treatment: an open-label, phase 2, dose-escalation study. Lancet, 378, 595-605.

Clark, R.M., Dalgliesh, G.L., Endres, D., Gomez, M., Taylor, J. and Bidichandani, S.I. (2004) Expansion of GAA triplet repeats in the human genome: unique origin of the FRDA mutation at the center of an Alu. Genomics, 83, 373-383.

Clark, R.M., De Biase, I., Malykhina, A.P., Al-Mandawi, S., Pook, M. and Bidichandani, S.I. (2007) The GAA triplet-repeat is unstable in the context of the human FXN locus and displays age-dependent expansions in cerebellum and DRG in a transgenic mouse model. Human genetics, 120, 633-640.

(56) References Cited

OTHER PUBLICATIONS

Ditch, S., Sammarco, M.C., Banerjee, A. and Grabczyk, E. (2009) Progressive GAA•TTC repeat expansion in human cell lines. PLoS genetics, 5, e1000704.
Entezam, A., Biacsi, R., Orrison, B., Saha, T., Hoffman, G.E., Grabczyk, E., Nussbaum, R.L. and Usdin, K. (2007) Regional FMRP deficits and large repeat expansions into the full mutation range in a new Fragile X premutation mouse model. Gene, 395, 125-134.
Ezzatizadeh, V., Sandi, C., Sandi, M., Anjomani-Virmouni, S., Al-Mandawi, S. and Pook, M.A. (2014) MutLalpha heterodimers modify the molecular phenotype of Friedreich ataxia. PloS one, 9, e100523.
Ferguson, D.P., Dangott, L.J. and Lightfoot, J.T. (2014) Lessons learned from vivo-morpholinos: How to avoid vivo-morpholino toxicity. BioTechniques, 56, 251-256.
Flores-Rozas, H. and Kolodner, R.D. (1998) The *Saccharomyces cerevisiae* MLH3 gene functions in MSH3-dependent suppression of frameshift mutations. Proceedings of the National Academy of Sciences of the United States of America, 95, 12404-12409.
Freier & Altmann, The ups and downs of nucleic acid duplex stability: structure:stability studies on chemically-modified DNA:RNA duplexes (1997) Nucl. Acid. Res., 25(22), 4429-4443.
Gatchel, Jr. and Zoghbi, H.Y. (2005) Diseases of unstable repeat expansion: mechanisms and common principles. Nature reviews. Genetics, 6, 743-755.
Global Market for Orphan Drugs is Expected to Reach $112 Billion in 2017. Drugs.com, Aug. 2013.
Goemans, N.M., Tulinius, M., van den Akker, J.T., Burm, B.E., Ekhart, P.F., Heuvelmans, N., Holling, T., Janson, A.A., Platenburg, G.J., Sipkens, J.A. et al. (2011) Systemic administration of PRO051 in Duchenne's muscular dystrophy. The New England journal of medicine, 364, 1513-1522.
Gomes-Pereira, M., Hilley, J.D., Morales, F., Adam, B., James, H.E. and Monckton, D.G. (2014) Disease-associated CAT.CTG triplet repeats expand rapidly in non-dividing mouse cells, but cell cycle arrest is insufficient to drive expansion. Nucleic acids research.
Grabczyk, E. and Usdin, K. (1999) Generation of microgram quantities of trinucleotide repeat tracts of defined length, interspersion pattern, and orientation. Analytical biochemistry, 267, 241-243.
Graham, F.L., Smiley, J., Russell, W.C. and Nairn, R. (1977) Characteristics of a human cell line transformed by DNA from human adenovirus type 5. The Journal of general virology, 36, 59-74.
Halabi, A., Ditch, S., Wang, J. and Grabczyk, E. (2012) DNA mismatch repair complex MutSbeta promotes GAA.TTC repeat expansion in human cells. The Journal of biological chemistry, 287, 29958-29967.
Herdewijn P., (2000) Heterocyclic Modifications of Oligonucleotides and Antisense Technology, Antisense & Nucleic Acid Drug Dev., 10:297-310.
Hienonen, T., Laiho, R, Salovaara, R., Mecklin, J.P., Jarvinen, H., Sistonen, P., Peltomaki, P., Lehtonen, R., Nupponen, N.N., Launonen, V. et al. (2003) Little evidence for involvement of MLH3 in colorectal cancer predisposition. Int J Cancer, 106, 292-296.
International Search Report dated Nov. 23, 2015.
Kinali, M., Arechavala-Gomeza, V., Feng, L., Cirak, S., Hunt, D., Adkin, C., Guglieri, M., Ashton, E., Abbs, S., Nihoyannopoulos, P. et al. (2009) Local restoration of dystrophin expression with the morpholino oligomer AVI-4658 in Duchenne muscular dystrophy: a single-blind, placebo-controlled, dose-escalation, proof-of-concept study. Lancet Neurol, 8, 918-928.
Kolodner et al. (1994) Structure of the human MSH2 locus and analysis of two Muir-Torre kindreds for msh2 mutations. Genomics, 24:3, 516-526.

Kurosaki, T., Ueda, S., Ishida, T., Abe, K., Ohno, K. and Matsuura, T. (2012) the unstable CCTG repeat responsible for myotonic dystrophy type 2 originates from an AluSx element insertion into an early primate genome. PloS one, 7, e38379.
Lavedan, C., Grabczyk, E., Usdin, K. and Nussbaum, R.L. (1998) Long uninterrupted CGG repeats within the first exon of the human FMR1 gene are not intrinsically unstable in transgenic mice. Genomics, 50, 229-240.
Lipkin, S.M., Moens, P.B., Wang, V., Lenzi, M., Shanmugarajah, D., Gilgeous, A., Thomas, J., Cheng, J., Touchman, J.W., Green, E.D. et al. (2002) Meiotic arrest and aneuploidy in MLH3-deficient mice. Nature genetics, 31, 385-390.
Lipkin, S.M., Wang, V., Jacoby, R., Banerjee-Basu, S., Baxevanis, A.D., Lynch, H.T., Elliott, R.M. and Collins, F.S. (2000) MLH3: a DNA mismatch repair gene associated with mammalian microsatellite instability. Nature genetics, 24, 27-35.
Liu, H.X., Zhou, X.L., Liu, T., Werelius, B., Lindmark, G., Dahl, N. and Lindblom, A. (2003) The role of hMLH3 in familial colorectal cancer. Cancer Res, 63, 1894-1899.
Manoharan M., (1999) 2' Carbohydrate modifications in antisense oligonucleotide therapy: importance of conformation, configuration and conjugation, Biochemica et Biophysica Acta 1489:117-139.
Matsuura, T., Fang, P., Lin, X., Khajavi, M., Tsuji, K., Rasmussen, A., Grewal, R.P., Achari, M., Alonso, M.E., Pulst, S. M. et al. (2004) Somatic and germline instability of the ATTCT repeat in spinocerebellar ataxia type 10. American journal of human genetics, 74, 1216-1224.
Mirkin, S.M. (2007) Expandable DNA repeats and human disease. Nature, 447, 932-940.
Morcos, P.A., Li, Y. and Jiang, S. (2008) Vivo-Morpholinos: a non-peptide transporter delivers Morpholinos into a wide array of mouse tissues. BioTechniques, 45, 613-614, 616, 618 passim.
Olmsted, J.B., Carlson, K., Klebe, R., Ruddle, F. and Rosenbaum, J. (1970) Isolation of microtubule protein from cultured mouse neuroblastoma cells. Proceedings of the National Academy of Sciences of the United States of America, 65, 129-136.
Porensky, R.N., Mitrpant, C., McGovern, V.L., Bevan, A.K., Foust, K.D., Kaspar, B.K., Wilton, S.D. and Burghes, A.H. (2012) A single administration of morpholino antisense oligomer rescues spinal muscular atrophy in mouse. Human molecular genetics, 21, 1625-1638.
Prolla, T.A., Pang, Q., Alani, E., Kolodner, R.D. and Liskay, R.M. (1994) MLH1, PMS1, and MSH2 interactions during the initiation of DNA mismatch repair in yeast. Science, 265, 1091-1093.
Raschle, M., Marra, G., Nystrom-Lahti, M., Schar, P. and Jiricny, J. (1999) Identification of hMutLbeta, a heterodimer of hMLH1 and hPMS1. The Journal of biological chemistry, 274, 32368-32375.
Shaw, G., Morse, S., Ararat, M. and Graham, F.L. (2002) Preferential transformation of human neuronal cells by human adenoviruses and the origin of HEK 293 cells. The FASEB journal : official publication of the Federation of American Societies for Experimental Biology, 16, 869-871.
Summerton, J. and Weller, D. (1997) Morpholino antisense oligomers: design, preparation, and properties. Antisense Nucleic Acid Drug Dev, 7, 187-195.
The Economic Power of Orphan Drugs. Thomson Reuters, 2012.
The New Economics of Orphan Diseases. Genetic Engineering & Biotechnology News, Jan. 1, 2013.
Tian, L., Hou, C., Tian, K., Holcomb, N.C., Gu, L. and Li, G.M. (2009) Mismatch recognition protein MutSbeta does not hijack (Cag)n hairpin repair in vitro. The Journal of biological chemistry, 284, 20452-20456.
Top 20 orphan drugs by 2018. FiercePharma, Jul. 23, 2013.

* cited by examiner

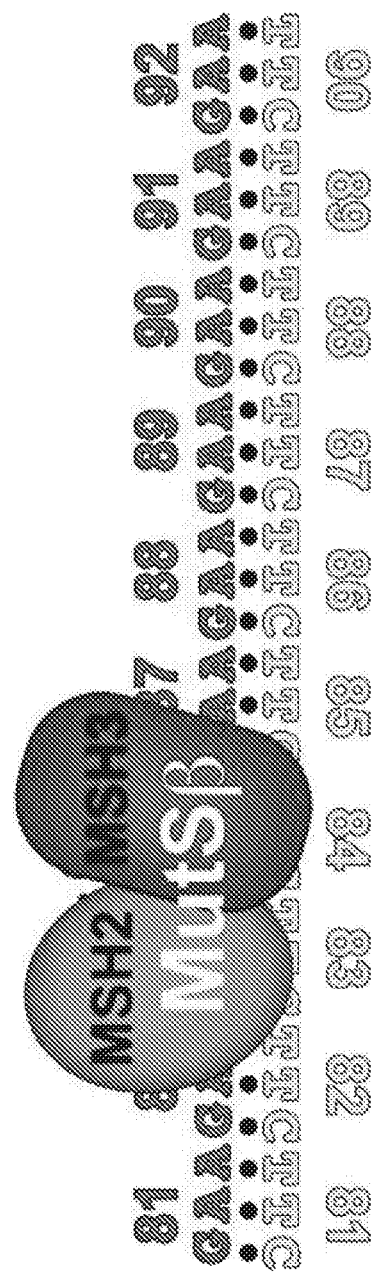
FIG. 1 - CONT.

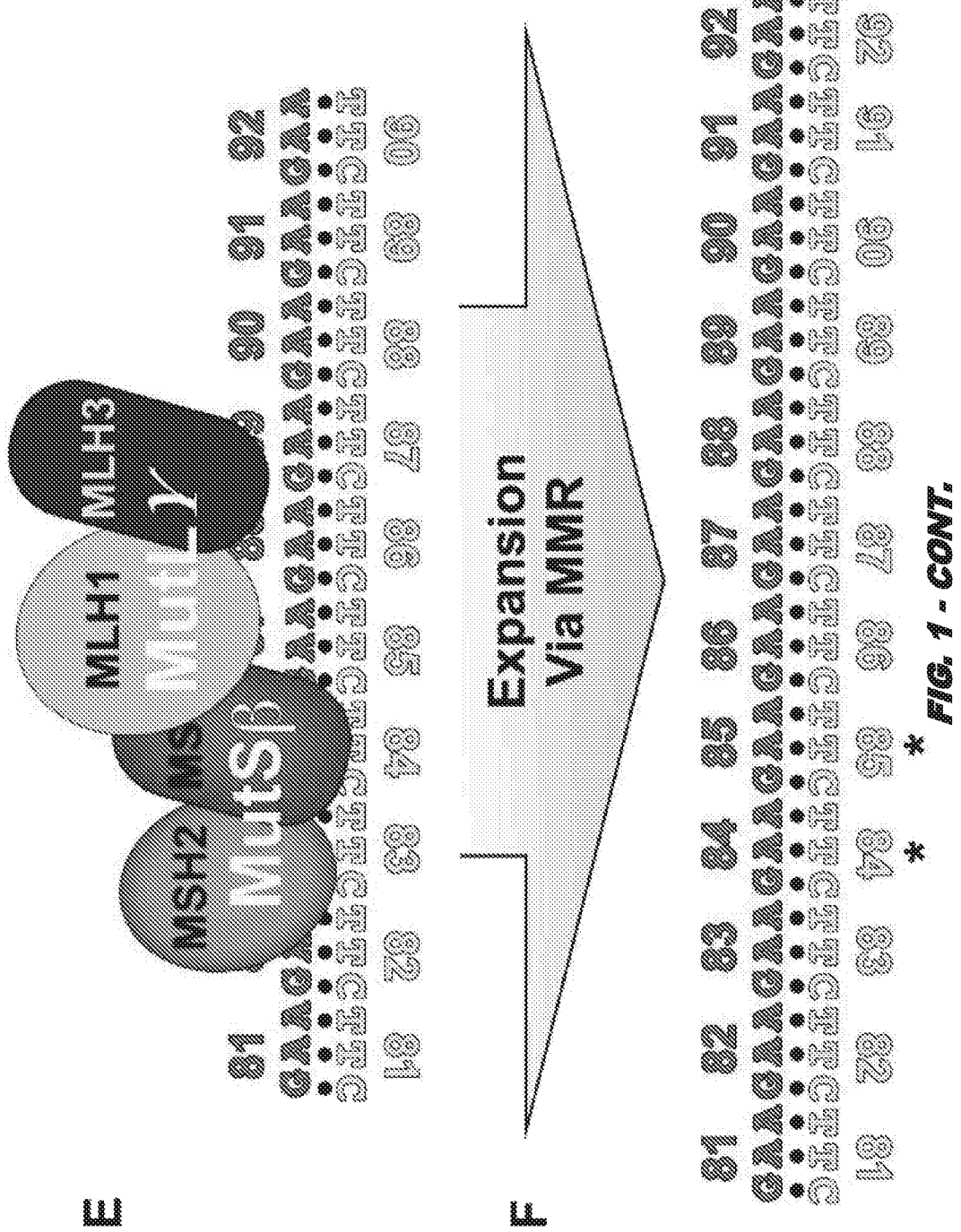
FIG. 1 - CONT.

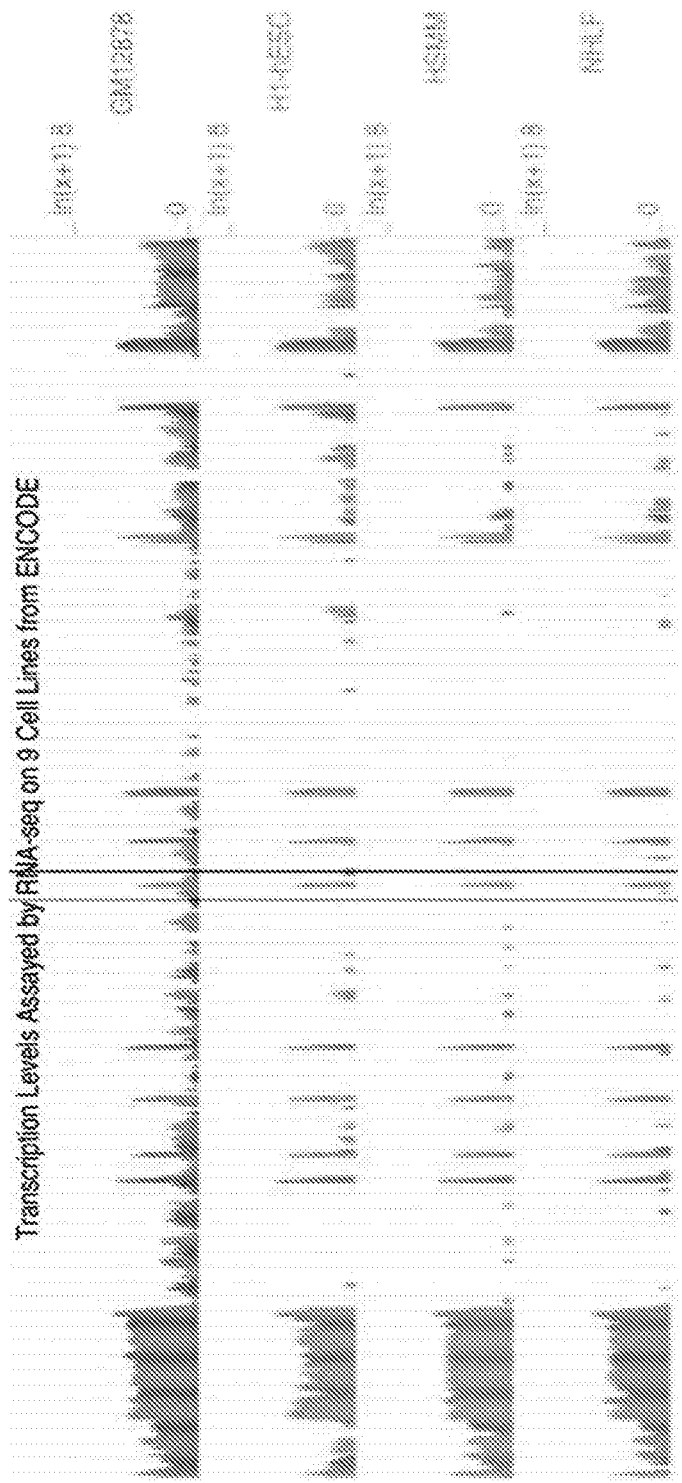
FIG. 9B – CONT.

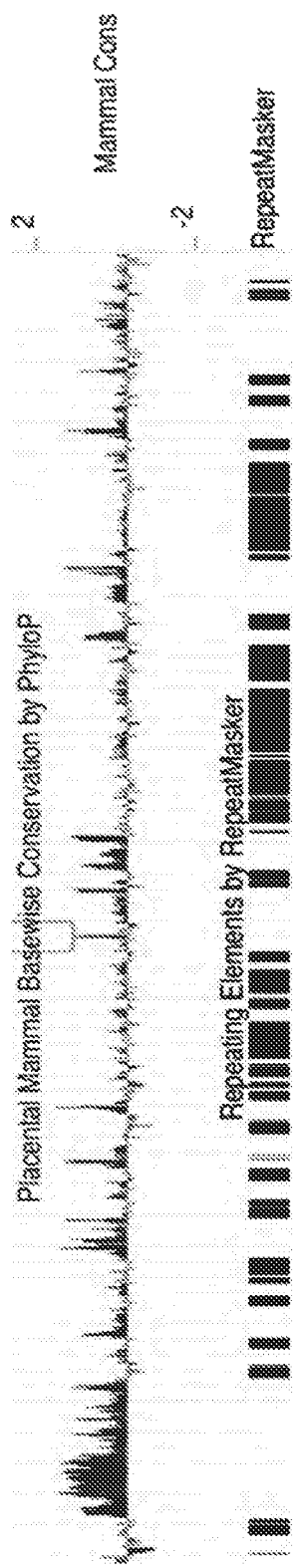
FIG. 9B – CONT.

COMPOSITIONS AND USES FOR TREATMENT THEREOF

This application is a continuation-in-part of PCT Application No. PCT/US2015/029724, filed May 7, 2015, which claims priority to U.S. Provisional Patent Application Ser. No. 61/989,898, filed May 7, 2014, and the entire disclosures of which are incorporated by reference in their entireties.

All patents, patent applications and publications cited herein are hereby incorporated by reference in their entirety. The disclosures of these publications in their entireties are hereby incorporated by reference into this application in order to more fully describe the state of the art as known to those skilled therein as of the date of the invention described and claimed herein This patent disclosure contains material that is subject to copyright protection. The copyright owner has no objection to the facsimile reproduction by anyone of the patent document or the patent disclosure as it appears in the U.S. Patent and Trademark Office patent file or records, but otherwise reserves any and all copyright rights.

SEQUENCE LISTING

The instant application contains a Sequence Listing which has been submitted electronically in ASCII format and is hereby incorporated by reference in its entirety. Said ASCII copy, created on Jun. 9, 2015, is named 2932719.3.W01_SL.txt and is 949,305 bytes in size.

FIELD OF THE INVENTION

The present invention relates generally to compositions for the treatment of DNA repeat expansion diseases. In one embodiment, the present disclosure relates to oligonucleotides directed to subunits of the DNA mismatch repair system. In one embodiment, the present disclosure relates to oligonucleotides directed at skipping of MLH3 exon 7 to slow the progression of repeat expansion disorders.

BACKGROUND OF THE INVENTION

Genomic instability underlies an increasing number of disorders, plays a major role in cancer and contributes to aging. DNA mismatch repair (MMR) is essential for maintaining genome integrity. However, when it comes to certain types of repetitive DNA, MMR actually contributes to genome instability. MMR has been implicated in repeat expansions of numerous disorders including Huntington's disease (HD) and myotonic dystrophy (DM). Friedreich ataxia (FRDA), the most common inherited ataxia, is a progressive neurodegenerative disorder caused by GAA•TTC repeat expansion in the first intron of the frataxin (FXN) gene. Currently there is no treatment and no cure for Friedreich ataxia or any of the many other DNA repeat expansion diseases. While each of the individual repeat expansion diseases is rare or not necessarily common, in aggregate, the victims of the currently known repeat expansion diseases number over 100,000 in the United States alone.

SUMMARY OF THE INVENTION

The invention is directed to therapeutics useful to slow the expansion rate in repeat expansion diseases. In one embodiment, a central mechanism is likely shared by all repeat expansion diseases thus useful in the treatment of many, if not all of the diseases in this class. For progressive repeat expansion diseases such as Friedreich ataxia or Huntington's disease MLH3 exon skipping may make it possible to delay or even prevent the onset of symptoms if treatment is started early. Chemically similar morpholino splice switching oligonucleotides (SSOs) are currently in human trials for exon skipping in Duchenne muscular dystrophy.

An aspect of the invention is directed to an isolated nuclease-resistant oligonucleotide comprising a nucleic acid sequence that hybridizes to a complementary target nucleic acid sequence of a gene or gene product encoding a component of a mismatch repair (MMR) complex. For example, the oligonucleotide comprises a sequence that specifically hybridizes in a human cell with a nucleic acid sequence encoding a subunit of the MMR system (e.g., MSH2, MSH3, MSH6, MLH1, MLH3, PMS1, or PMS2). In one embodiment, the nucleic acid sequence is a complementary sequence for a human MLH3 gene or gene product. In one embodiment, the nuclease-resistant oligonucleotide is useful for inducing exon skipping. For example, oligonucleotide(s) can induce skipping of MSH2 exon 1, 2, 3, 4, 5, 6, 7, 8, 9, 10, 11, 12, 13, 14, 15, 16, or a combination of MSH2 exons. Oligonucleotide(s) can induce skipping of MSH3 exon 1, 2, 3, 4, 5, 6, 7, 8, 9, 10, 11, 12, 13, 14, 15, 16, 17, 18, 19, 20, 21, 22, 23, 24, or a combination of MSH3 exons. Oligonucleotide(s) can induce skipping of MSH6 exon 1, 2, 3, 4, 5, 6, 7, 8, 9, 10, or a combination of MSH6 exons. Oligonucleotide(s) can induce skipping of MLH1 exon 1, 2, 3, 4, 5, 6, 7, 8, 9, 10, 11, 12, 13, 14, 15, 16, 17, 18, 19, or a combination of MLH1 exons. Oligonucleotide(s) can induce skipping of MLH3 exon 1, 2, 3, 4, 5, 6, 7, 8, 9, 10, 11, 12, 13, or a combination of MLH3 exons. Oligonucleotide(s) can induce skipping of PMS1 exon 1, 2, 3, 4, 5, 6, 7, 8, 9, 10, 11, 12, 13, or a combination of PMS1 exons. Oligonucleotide(s) can induce skipping of PMS2 exon 1, 2, 3, 4, 5, 6, 7, 8, 9, 10, 11, 12, 13, 14, 15, or a combination of PMS2 exons. In one embodiment, the oligonucleotide directs skipping of one or more exons of MSH2, MSH3, MSH6, PMS1, PMS2, MLH1, or MLH3. In one embodiment, one or more oligonucleotides can induce skipping of MLH3 exon 7. In one embodiment, the oligonucleotide is decreases the rate of DNA repeat expansion. In one embodiment, the oligonucleotide is useful in treating a DNA repeat expansion disease. In one embodiment, the target nucleic acid sequence is located on human chromosome 2, 3, 5, 7, or 14. In one embodiment, the target nucleic acid sequence (or target complementary nucleic acid sequence) comprises: a nucleic acid sequence corresponding to a region of interest for any one of the exons 1-16 described herein for GenBank Accession No. NG 007110.2, or to an intron-exon junction, or to an exon-intron junction listed with GenBank Accession No. NG_007110.2; a nucleic acid sequence corresponding to a region of interest for any one of the exons 1-24 described herein for GenBank Accession No. NG_016607.1, or to an intron-exon junction, or to an exon-intron junction listed with GenBank Accession No. NG_016607.1; a nucleic acid sequence corresponding to a region of interest for any one of the exons 1-10 described herein for GenBank Accession No. NG_007111.1 or SEQ ID NO: 33, or to an intron-exon junction, or to an exon-intron junction listed with GenBank Accession No. NG_007111.1 or SEQ ID NO: 33; a nucleic acid sequence corresponding to a region of interest for any one of the exons 1-19 described herein for GenBank Accession No. NG_007109.2, or to an intron-exon junction, or to an exon-intron junction listed with GenBank Accession No. NG_007109.2; a nucleic acid sequence corresponding to a region of interest for any one of the exons 1-13 described herein for GenBank Accession No. NG_008648.1, or to an intron-exon junction, or to an exon-intron junction listed with GenBank Accession No. NG_008648.1; a nucleic acid sequence corresponding to a region of interest for any one of the exons 1-13 described herein for GenBank Accession No. NG_008649.1 or SEQ ID NO: 1, or to an intron-exon junction, or to an exon-intron junction listed with GenBank Accession No. NG_008649.1 or SEQ ID NO: 1; or a nucleic acid sequence corresponding to a region of interest for any one of the exons 1-15 described herein for GenBank Accession No. NG_008466.1, or to an intron-exon junction, or to an exon-intron junction listed with GenBank Accession No. NG_008466.1. In one embodiment, the component of the MMR complex comprises MutS or MutL. In one embodiment, MutS comprises a subunit selected from the group consisting of MSH2, MSH3, and MSH6. In one embodiment, MutL comprises a subunit selected from the group consisting of MLH1, MLH3, PMS1, and PMS2. In one embodiment, MLH3 comprises SEQ ID NO: 1. In one embodiment, the oligonucleotide hybridizes to the target complementary nucleic acid sequence comprising SEQ ID NO: 2. In one embodiment, the oligonucleotide has at least 60%, at least 65%, at least 70%, at least 80%, at least 85%, at least 90%, at least 91%, at least 92%, at least 93%, at least 94%, at least 95%, at least 96%, at least 97%, at least 98%, at least 99%, or 100% identity to a nucleic acid sequence comprising SEQ ID NO: 3 or SEQ ID NO: 4. In one embodiment, the oligonucleotide has at least 60%, at least 65%, at least 70%, at least 80%, at least 85%, at least 90%, at least 91%, at least 92%, at least 93%, at least 94%, at least 95%, at least 96%, at least 97%, at least 98%, at least 99%, or 100% identity to a nucleic acid sequence depicted in Table 4. In one embodiment, the oligonucleotide comprises 15 to 30 nucleotide bases in length. In one embodiment, the oligonucleotide comprises one or more morpholino subunits, one or more locked nucleic acid subunits, one or more 2-O-methyl moieties, or one or more peptide moieties.

An aspect of the invention is directed to a pharmaceutical composition comprising a nuclease-resistant oligonucleotide comprising a nucleic acid sequence that hybridizes to a complementary target nucleic acid sequence of a gene or gene product encoding a component of a mismatch repair (MMR) complex, and a pharmaceutically acceptable carrier. For example, the oligonucleotide comprises a sequence that specifically hybridizes in a human cell with a nucleic acid sequence encoding a subunit of the MMR system (e.g., MSH2, MSH3, MSH6, MLH1, MLH3, PMS1, or PMS2). In one embodiment, the nucleic acid sequence is a complementary sequence for a human MLH3 gene or gene product. In one embodiment, the nuclease-resistant oligonucleotide is useful for inducing exon skipping. For example, oligonucleotide(s) can induce skipping of MSH2 exon 1, 2, 3, 4, 5, 6, 7, 8, 9, 10, 11, 12, 13, 14, 15, 16, or a combination of MSH2 exons. Oligonucleotide(s) can induce skipping of MSH3 exon 1, 2, 3, 4, 5, 6, 7, 8, 9, 10, 11, 12, 13, 14, 15, 16, 17, 18, 19, 20, 21, 22, 23, 24, or a combination of MSH3 exons. Oligonucleotide(s) can induce skipping of MSH6 exon 1, 2, 3, 4, 5, 6, 7, 8, 9, 10, or a combination of MSH6 exons. Oligonucleotide(s) can induce skipping of MLH1 exon 1, 2, 3, 4, 5, 6, 7, 8, 9, 10, 11, 12, 13, 14, 15, 16, 17, 18, 19, or a combination of MLH1 exons. Oligonucleotide(s) can induce skipping of MLH3 exon 1, 2, 3, 4, 5, 6, 7, 8, 9, 10, 11, 12, 13, or a combination of MLH3 exons. Oligonucleotide(s) can induce skipping of PMS1 exon 1, 2, 3, 4, 5, 6, 7, 8, 9, 10, 11, 12, 13, or a combination of PMS1 exons. Oligonucleotide(s) can induce skipping of PMS2 exon 1, 2, 3, 4, 5, 6, 7, 8, 9, 10, 11, 12, 13, 14, 15, or a combination of PMS2 exons. In one embodiment, the oligonucleotide directs skipping of one or more exons of MSH2, MSH3, MSH6, PMS1, PMS2, MLH1, or MLH3. In one embodiment, one or more oligonucleotides can induce skipping of MLH3 exon 7. In one embodiment, the oligonucleotide decreases the rate of DNA repeat expansion. In one embodiment, the oligonucleotide is useful in treating a DNA repeat expansion disease. In one embodiment, the target nucleic acid sequence is located on human chromosome 2, 3, 5, 7, or 14. In one embodiment, the target nucleic acid sequence (or target complementary nucleic acid sequence) comprises: a nucleic acid sequence corresponding to a region of interest for any one of the exons 1-16 described herein for GenBank Accession No. NG_007110.2, or to an intron-exon junction, or to an exon-intron junction listed with GenBank Accession No. NG_007110.2; a nucleic acid sequence corresponding to a region of interest for any one of the exons 1-24 described herein for GenBank Accession No. NG_016607.1, or to an intron-exon junction, or to an exon-intron junction listed with GenBank Accession No. NG_016607.1; a nucleic acid sequence corresponding to a region of interest for any one of the exons 1-10 described herein for GenBank Accession No. NG_007111.1 or SEQ ID NO: 33, or to an intron-exon junction, or to an exon-intron junction listed with GenBank Accession No. NG_007111.1 or SEQ ID NO: 33; a nucleic acid sequence corresponding to a region of interest for any one of the exons 1-19 described herein for GenBank Accession No. NG_007109.2, or to an intron-exon junction, or to an exon-intron junction listed with GenBank Accession No. NG_007109.2; a nucleic acid sequence corresponding to a region of interest for any one of the exons 1-13 described herein for GenBank Accession No. NG_008648.1, or to an intron-exon junction, or to an exon-intron junction listed with GenBank Accession No. NG_008648.1; a nucleic acid sequence corresponding to a region of interest for any one of the exons 1-13 described herein for GenBank Accession No. NG_008649.1 or SEQ ID NO: 1, or to an intron-exon junction, or to an exon-intron junction listed with GenBank Accession No. NG_008649.1 or SEQ ID NO: 1; or a nucleic acid sequence corresponding to a region of interest for any one of the exons 1-15 described herein for GenBank Accession No. NG_008466.1, or to an intron-exon junction, or to an exon-intron junction listed with GenBank Accession No. NG_008466.1. In one embodiment, the component of the MMR complex comprises MutS or MutL. In one embodiment, MutS comprises a subunit selected from the group consisting of MSH2, MSH3, and MSH6. In one embodiment, MutL comprises a subunit selected from the group consisting of MLH1, MLH3, PMS1, and PMS2. In one embodiment, MLH3 comprises SEQ ID NO: 1. In one embodiment, the oligonucleotide hybridizes to the target complementary nucleic acid sequence comprising SEQ ID NO: 2. In one embodiment, the oligonucleotide has at least 60%, at least 65%, at least 70%, at least 80%, at least 85%, at least 90%, at least 91%, at least 92%, at least 93%, at least 94%, at least 95%, at least 96%, at least 97%, at least 98%, at least 99%, or 100% identity to a nucleic acid sequence comprising SEQ ID NO: 3 or SEQ ID NO: 4. In one embodiment, the oligonucleotide has at least 60%, at least 65%, at least 70%, at least 80%, at least 85%, at least 90%, at least 91%, at least 92%, at least 93%, at least 94%, at least 95%, at least 96%, at least 97%, at least 98%, at least 99%, or 100% identity to a nucleic acid sequence depicted in Table 4. In one embodiment, the oligonucleotide comprises 15 to 30 nucleotide bases in length. In one embodiment, the oligonucleotide comprises one or more morpholino subunits, one or more locked nucleic acid subunits, one or more 2-O-methyl moieties, or one or more peptide moieties.

An aspect of the invention is directed to a pharmaceutical composition comprising a nuclease-resistant oligonucleotide 15 to 30 nucleotide bases in length targeted to a complementary nucleic acid sequence of a gene or gene product encoding a MutS or MutL subunit, wherein the oligonucleotide hybridizes with and decreases the expression of the human MutS or MutL subunit by at least 20%, and wherein the oligonucleotide comprises at least one modification. In one embodiment, the modification comprises a phosphorothioate backbone. In one embodiment, the modification comprises a phosphorodiamidate morpholino nucleotide. In one embodiment, the modification results in a charge-negative oligonucleotide. In one embodiment, the modification results in a charge-neutral oligonucleotide. In one embodiment, the modification comprises a phosphorodiamidate morpholino nucleotide, or a 2-aminoethylglycine functionalized nucleotide. In one embodiment, the modification comprises a phosphorothioate backbone, a 5-methylcytosine nucleotide, a 2'-O-methoxyethyl sugar moiety, a locked nucleic acid subunit, an ethylene-bridged nucleic acid subunit, or a combination thereof. In one embodiment, MutS comprises a subunit selected from the group consisting of MSH2, MSH3, and MSH6. In one embodiment, MutL comprises a subunit selected from the group consisting of MLH1, MLH3, PMS1, and PMS2. In one embodiment, MLH3 comprises SEQ ID NO: 1. In one embodiment, the oligonucleotide of the composition hybridizes to the target complementary nucleic acid sequence comprising SEQ ID NO: 2. In one embodiment, the oligonucleotide has at least 60%, at least 65%, at least 70%, at least 80%, at least 85%, at least 90%, at least 91%, at least 92%, at least 93%, at least 94%, at least 95%, at least 96%, at least 97%, at least 98%, at least 99%, or 100% identity to a nucleic acid sequence comprising SEQ ID NO: 3 or SEQ ID NO: 4. In one embodiment, the oligonucleotide has at least 60%, at least 65%, at least 70%, at least 80%, at least 85%, at least 90%, at least 91%, at least 92%, at least 93%, at least 94%, at least 95%, at least 96%, at least 97%, at least 98%, at least 99%, or 100% identity to a nucleic acid sequence depicted in Table 4. In one embodiment, the nuclease-resistant oligonucleotide of the composition is useful for inducing exon skipping. For example, oligonucleotide(s) can induce skipping of MSH2 exon 1, 2, 3, 4, 5, 6, 7, 8, 9, 10, 11, 12, 13, 14, 15, 16, or a combination of MSH2 exons. Oligonucleotide(s) can induce skipping of MSH3 exon 1, 2, 3, 4, 5, 6, 7, 8, 9, 10, 11, 12, 13, 14, 15, 16, 17, 18, 19, 20, 21, 22, 23, 24, or a combination of MSH3 exons. Oligonucleotide(s) can induce skipping of MSH6 exon 1, 2, 3, 4, 5, 6, 7, 8, 9, 10, or a combination of MSH6 exons. Oligonucleotide(s) can induce skipping of MLH1 exon 1, 2, 3, 4, 5, 6, 7, 8, 9, 10, 11, 12, 13, 14, 15, 16, 17, 18, 19, or a combination of MLH1 exons. Oligonucleotide(s) can induce skipping of MLH3 exon 1, 2, 3, 4, 5, 6, 7, 8, 9, 10, 11, 12, 13, or a combination of MLH3 exons. Oligonucleotide(s) can induce skipping of PMS1 exon 1, 2, 3, 4, 5, 6, 7, 8, 9, 10, 11, 12, 13, or a combination of PMS1 exons. Oligonucleotide(s) can induce skipping of PMS2 exon 1, 2, 3, 4, 5, 6, 7, 8, 9, 10, 11, 12, 13, 14, 15, or a combination of PMS2 exons. In one embodiment, the oligonucleotide of the composition directs skipping of one or more exons of MSH2, MSH3, MSH6, PMS1, PMS2, MLH1, or MLH3. In one embodiment, the oligonucleotide(s) of the composition can induce skipping of MLH3 exon 7. In one embodiment, the oligonucleotide of the composition hybridizes with and decreases the expression of the human MutS or MutL subunit by at least 25%, at least 30%, at least 35%, at least 40%, at least 45%, at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100%.

An aspect of the invention provides for an oligonucleotide complex for modulating the expression or activity of a gene or gene product encoding a component of a mismatch repair (MMR) system, the complex comprising a first oligonucleotide and a second oligonucleotide, wherein the first oligonucleotide comprises a sequence complementary to an acceptor region of an exon of a gene encoding a MutS or MutL subunit, and wherein the nucleic acid sequence of the first oligonucleotide comprises a nuclease-resistant modification, and wherein the second oligonucleotide comprises a sequence complementary to a donor region of an exon of a gene encoding a MutS or MutL subunit, and wherein the nucleic acid sequence of the second oligonucleotide comprises a nuclease-resistant modification. An aspect of the invention is directed to an oligonucleotide complex for modulating the expression or activity of a gene or gene product encoding a component of a mismatch repair (MMR) system, the complex comprising a first oligonucleotide and a second oligonucleotide, wherein the first oligonucleotide comprises a sequence complementary to an acceptor region of an exon of a gene encoding a MutS or MutL subunit, and wherein the nucleic acid sequence of the first oligonucleotide comprises a nuclease-resistant modification, and wherein the second oligonucleotide comprises a sequence complementary to a donor region of an exon of a gene encoding a MutS or MutL subunit. An aspect of the invention provides for an oligonucleotide complex for modulating the expression or activity of a gene or gene product encoding a component of a mismatch repair (MMR) system, the complex comprising a first oligonucleotide and a second oligonucleotide, wherein the first oligonucleotide comprises a sequence complementary to an acceptor region of an exon of a gene encoding a MutS or MutL subunit, and wherein the second oligonucleotide comprises a sequence complementary to a donor region of an exon of a gene encoding a MutS or MutL subunit, and wherein the nucleic acid sequence of the second oligonucleotide comprises a nuclease-resistant modification. In one embodiment, the nuclease-resistant modification comprises one or more morpholino subunits, one or more locked nucleic acid subunits, one or more 2-O-methyl moieties, one or more peptide moieties, or a combination thereof. In one embodiment, the first oligonucleotide comprises a nucleic acid sequence having at least 60%, at least 65%, at least 70%, at least 80%, at least 85%, at least 90%, at least 91%, at least 92%, at least 93%, at least 94%, at least 95%, at least 96%, at least 97%, at least 98%, at least 99%, or 100% identity to a nucleic acid sequence comprising SEQ ID NO: 3 or SEQ ID NO: 4. In one embodiment, the first oligonucleotide comprises a nucleic acid sequence having at least 60%, at least 65%, at least 70%, at least 80%, at least 85%, at least 90%, at least 91%, at least 92%, at least 93%, at least 94%, at least 95%, at least 96%, at least 97%, at least 98%, at least 99%, or 100% identity to a nucleic acid sequence depicted in Table 4. In one embodiment, the first oligonucleotide is directed to a target nucleic acid sequence (or target complementary nucleic acid sequence) comprising: a nucleic acid sequence corresponding to a region of interest for any one of the exons 1-16 described herein for GenBank Accession No. NG_007110.2, or to an intron-exon junction, or to an exon-intron junction listed with GenBank Accession No.

NG_007110.2; a nucleic acid sequence corresponding to a region of interest for any one of the exons 1-24 described herein for GenBank Accession No. NG_016607.1, or to an intron-exon junction, or to an exon-intron junction listed with GenBank Accession No. NG_016607.1; a nucleic acid sequence corresponding to a region of interest for any one of the exons 1-10 described herein for GenBank Accession No. NG_007111.1 or SEQ ID NO: 33, or to an intron-exon junction, or to an exon-intron junction listed with GenBank Accession No. NG_007111.1 or SEQ ID NO: 33; a nucleic acid sequence corresponding to a region of interest for any one of the exons 1-19 described herein for GenBank Accession No. NG_007109.2, or to an intron-exon junction, or to an exon-intron junction listed with GenBank Accession No. NG_007109.2; a nucleic acid sequence corresponding to a region of interest for any one of the exons 1-13 described herein for GenBank Accession No. NG_008648.1, or to an intron-exon junction, or to an exon-intron junction listed with GenBank Accession No. NG_008648.1; a nucleic acid sequence corresponding to a region of interest for any one of the exons 1-13 described herein for GenBank Accession No. NG_008649.1 or SEQ ID NO: 1, or to an intron-exon junction, or to an exon-intron junction listed with GenBank Accession No. NG_008649.1 or SEQ ID NO: 1; or a nucleic acid sequence corresponding to a region of interest for any one of the exons 1-15 described herein for GenBank Accession No. NG_008466.1, or to an intron-exon junction, or to an exon-intron junction listed with GenBank Accession No. NG_008466.1. In one embodiment, the second oligonucleotide comprises a nucleic acid sequence having at least 60%, at least 65%, at least 70%, at least 80%, at least 85%, at least 90%, at least 91%, at least 92%, at least 93%, at least 94%, at least 95%, at least 96%, at least 97%, at least 98%, at least 99%, or 100% identity to a nucleic acid sequence comprising SEQ ID NO: 3 or SEQ ID NO: 4. In one embodiment, the second oligonucleotide comprises a nucleic acid sequence having at least 60%, at least 65%, at least 70%, at least 80%, at least 85%, at least 90%, at least 91%, at least 92%, at least 93%, at least 94%, at least 95%, at least 96%, at least 97%, at least 98%, at least 99%, or 100% identity to a nucleic acid sequence depicted in Table 4. In one embodiment, the second oligonucleotide is directed to a target nucleic acid sequence (or target complementary nucleic acid sequence) comprising: a nucleic acid sequence corresponding to a region of interest for any one of the exons 1-16 described herein for GenBank Accession No. NG_007110.2, or to an intron-exon junction, or to an exon-intron junction listed with GenBank Accession No. NG_007110.2; a nucleic acid sequence corresponding to a region of interest for any one of the exons 1-24 described herein for GenBank Accession No. NG_016607.1, or to an intron-exon junction, or to an exon-intron junction listed with GenBank Accession No. NG_016607.1; a nucleic acid sequence corresponding to a region of interest for any one of the exons 1-10 described herein for GenBank Accession No. NG_007111.1 or SEQ ID NO: 33, or to an intron-exon junction, or to an exon-intron junction listed with GenBank Accession No. NG_007111.1 or SEQ ID NO: 33; a nucleic acid sequence corresponding to a region of interest for any one of the exons 1-19 described herein for GenBank Accession No. NG_007109.2, or to an intron-exon junction, or to an exon-intron junction listed with GenBank Accession No. NG_007109.2; a nucleic acid sequence corresponding to a region of interest for any one of the exons 1-13 described herein for GenBank Accession No. NG_008648.1, or to an intron-exon junction, or to an exon-intron junction listed with GenBank Accession No. NG_008648.1; a nucleic acid sequence corresponding to a region of interest for any one of the exons 1-13 described herein for GenBank Accession No. NG_008649.1 or SEQ ID NO: 1, or to an intron-exon junction, or to an exon-intron junction listed with GenBank Accession No. NG_008649.1 or SEQ ID NO: 1; or a nucleic acid sequence corresponding to a region of interest for any one of the exons 1-15 described herein for GenBank Accession No. NG_008466.1, or to an intron-exon junction, or to an exon-intron junction listed with GenBank Accession No. NG_008466.1. In one embodiment, MutS comprises a subunit selected from the group consisting of MSH2, MSH3, and MSH6. In one embodiment, MutL comprises a subunit selected from the group consisting of MLH1, MLH3, PMS1, and PMS2. In one embodiment, MLH3 comprises SEQ ID NO: 1. In one embodiment, modulation of expression or activity is a decrease in the expression or activity of the human MutS or MutL subunit by at least 25%, at least 30%, at least 35%, at least 40%, at least 45%, at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100%.

An aspect of the invention provides for a kit for the treatment of a DNA Repeat Expansion Disease (DRED). In one embodiment, the kit comprises an oligonucleotide complex described herein and instructions for use. In one embodiment, the oligonucleotides of the complex comprise a nucleic acid sequence having at least 60%, at least 65%, at least 70%, at least 80%, at least 85%, at least 90%, at least 91%, at least 92%, at least 93%, at least 94%, at least 95%, at least 96%, at least 97%, at least 98%, at least 99%, or 100% identity to a nucleic acid sequence comprising SEQ ID NO: 3 or SEQ ID NO: 4. In one embodiment, the oligonucleotides if the complex comprise a nucleic acid sequence having at least 60%, at least 65%, at least 70%, at least 80%, at least 85%, at least 90%, at least 91%, at least 92%, at least 93%, at least 94%, at least 95%, at least 96%, at least 97%, at least 98%, at least 99%, or 100% identity to a nucleic acid sequence depicted in Table 4. In one embodiment, the oligonucleotides of the complex can be directed to a target nucleic acid sequence (or target complementary nucleic acid sequence) comprising: a nucleic acid sequence corresponding to a region of interest for any one of the exons 1-16 described herein for GenBank Accession No. NG_007110.2, or to an intron-exon junction, or to an exon-intron junction listed with GenBank Accession No. NG_007110.2; a nucleic acid sequence corresponding to a region of interest for any one of the exons 1-24 described herein for GenBank Accession No. NG_016607.1, or to an intron-exon junction, or to an exon-intron junction listed with GenBank Accession No. NG_016607.1; a nucleic acid sequence corresponding to a region of interest for any one of the exons 1-10 described herein for GenBank Accession No. NG_007111.1 or SEQ ID NO: 33, or to an intron-exon junction, or to an exon-intron junction listed with GenBank Accession No. NG_007111.1 or SEQ ID NO: 33; a nucleic acid sequence corresponding to a region of interest for any one of the exons 1-19 described herein for GenBank Accession No. NG_007109.2, or to an intron-exon junction, or to an exon-intron junction listed with GenBank Accession No. NG_007109.2; a nucleic acid sequence corresponding to a region of interest for any one of the exons 1-13 described herein for GenBank Accession No. NG_008648.1, or to an intron-exon junction, or to an exon-intron junction listed with GenBank Accession No. NG_008648.1; a nucleic acid sequence corresponding to a region of interest for any one of the exons 1-13 described herein for GenBank Accession No.

NG_008649.1 or SEQ ID NO: 1, or to an intron-exon junction, or to an exon-intron junction listed with GenBank Accession No. NG_008649.1 or SEQ ID NO: 1; or a nucleic acid sequence corresponding to a region of interest for any one of the exons 1-15 described herein for GenBank Accession No. NG_008466.1, or to an intron-exon junction, or to an exon-intron junction listed with GenBank Accession No. NG_008466.1.

An aspect of the invention provides for a kit for the treatment of a DNA Repeat Expansion Disease (DRED). In one embodiment, the kit comprises a nuclease-resistant oligonucleotide compound as described herein and instructions for use. In one embodiment, the oligonucleotide comprises a nucleic acid sequence having at least 60%, at least 65%, at least 70%, at least 80%, at least 85%, at least 90%, at least 91%, at least 92%, at least 93%, at least 94%, at least 95%, at least 96%, at least 97%, at least 98%, at least 99%, or 100% identity to a nucleic acid sequence comprising SEQ ID NO: 3 or SEQ ID NO: 4. In one embodiment, the oligonucleotide comprises a nucleic acid sequence having at least 60%, at least 65%, at least 70%, at least 80%, at least 85%, at least 90%, at least 91%, at least 92%, at least 93%, at least 94%, at least 95%, at least 96%, at least 97%, at least 98%, at least 99%, or 100% identity to a nucleic acid sequence depicted in Table 4. In one embodiment, the oligonucleotide can be directed to a target nucleic acid sequence (or target complementary nucleic acid sequence) comprising: a nucleic acid sequence corresponding to a region of interest for any one of the exons 1-16 described herein for GenBank Accession No. NG_007110.2, or to an intron-exon junction, or to an exon-intron junction listed with GenBank Accession No. NG_007110.2; a nucleic acid sequence corresponding to a region of interest for any one of the exons 1-24 described herein for GenBank Accession No. NG_016607.1, or to an intron-exon junction, or to an exon-intron junction listed with GenBank Accession No. NG_016607.1; a nucleic acid sequence corresponding to a region of interest for any one of the exons 1-10 described herein for GenBank Accession No. NG_007111.1 or SEQ ID NO: 33, or to an intron-exon junction, or to an exon-intron junction listed with GenBank Accession No. NG_007111.1 or SEQ ID NO: 33; a nucleic acid sequence corresponding to a region of interest for any one of the exons 1-19 described herein for GenBank Accession No. NG_007109.2, or to an intron-exon junction, or to an exon-intron junction listed with GenBank Accession No. NG_007109.2; a nucleic acid sequence corresponding to a region of interest for any one of the exons 1-13 described herein for GenBank Accession No. NG_008648.1, or to an intron-exon junction, or to an exon-intron junction listed with GenBank Accession No. NG_008648.1; a nucleic acid sequence corresponding to a region of interest for any one of the exons 1-13 described herein for GenBank Accession No. NG_008649.1 or SEQ ID NO: 1, or to an intron-exon junction, or to an exon-intron junction listed with GenBank Accession No. NG_008649.1 or SEQ ID NO: 1; or a nucleic acid sequence corresponding to a region of interest for any one of the exons 1-15 described herein for GenBank Accession No. NG_008466.1, or to an intron-exon junction, or to an exon-intron junction listed with GenBank Accession No. NG_008466.1. In one embodiment, the DRED is selected from those diseases listed in Table 1 or Table 2.

An aspect of the invention provides for a kit for monitoring the efficacy of treatment of a DNA Repeat Expansion Disease (DRED) in a subject. In one embodiment, the kit comprises at least one primer and instructions for use. In one embodiment, the kit comprises a second primer. In one embodiment, the primer comprises a nucleic acid sequence having at least 80%, at least 85%, at least 90%, at least 91%, at least 92%, at least 93%, at least 94%, at least 95%, at least 96%, at least 97%, at least 98%, at least 99%, or 100% identity to a nucleic acid sequence comprising SEQ ID NO: 5. In one embodiment, the primer comprises a nucleic acid sequence having at least 80%, at least 85%, at least 90%, at least 91%, at least 92%, at least 93%, at least 94%, at least 95%, at least 96%, at least 97%, at least 98%, at least 99%, or 100% identity to a nucleic acid sequence comprising SEQ ID NO: 29. In one embodiment, the primer comprises a nucleic acid sequence having at least 80%, at least 85%, at least 90%, at least 91%, at least 92%, at least 93%, at least 94%, at least 95%, at least 96%, at least 97%, at least 98%, at least 99%, or 100% identity to a nucleic acid sequence comprising SEQ ID NO: 30. In one embodiment, the primer comprises a nucleic acid sequence having at least 80%, at least 85%, at least 90%, at least 91%, at least 92%, at least 93%, at least 94%, at least 95%, at least 96%, at least 97%, at least 98%, at least 99%, or 100% identity to a nucleic acid sequence comprising SEQ ID NO: 6. In one embodiment, the primer comprises a nucleic acid sequence having at least 80%, at least 85%, at least 90%, at least 91%, at least 92%, at least 93%, at least 94%, at least 95%, at least 96%, at least 97%, at least 98%, at least 99%, or 100% identity to a nucleic acid sequence comprising SEQ ID NO: 31. In one embodiment, the primer comprises a nucleic acid sequence having at least 80%, at least 85%, at least 90%, at least 91%, at least 92%, at least 93%, at least 94%, at least 95%, at least 96%, at least 97%, at least 98%, at least 99%, or 100% identity to a nucleic acid sequence comprising SEQ ID NO: 32. In one embodiment, the DRED is selected from those diseases listed in Table 1 or Table 2.

An aspect of the invention also provides for a kit for monitoring the progression of a DNA Repeat Expansion Disease (DRED). In one embodiment, the kit comprises a primer directed to a complementary target nucleic acid sequence of a gene or gene product encoding MLH3 and instructions for use. In one embodiment, the kit comprises a second primer. In one embodiment, the primer comprises a nucleic acid sequence having at least 80%, at least 85%, at least 90%, at least 91%, at least 92%, at least 93%, at least 94%, at least 95%, at least 96%, at least 97%, at least 98%, at least 99%, or 100% identity to a nucleic acid sequence comprising SEQ ID NO: 5. In one embodiment, the primer comprises a nucleic acid sequence having at least 80%, at least 85%, at least 90%, at least 91%, at least 92%, at least 93%, at least 94%, at least 95%, at least 96%, at least 97%, at least 98%, at least 99%, or 100% identity to a nucleic acid sequence comprising SEQ ID NO: 29. In one embodiment, the primer comprises a nucleic acid sequence having at least 80%, at least 85%, at least 90%, at least 91%, at least 92%, at least 93%, at least 94%, at least 95%, at least 96%, at least 97%, at least 98%, at least 99%, or 100% identity to a nucleic acid sequence comprising SEQ ID NO: 30. In one embodiment, the primer comprises a nucleic acid sequence having at least 80%, at least 85%, at least 90%, at least 91%, at least 92%, at least 93%, at least 94%, at least 95%, at least 96%, at least 97%, at least 98%, at least 99%, or 100% identity to a nucleic acid sequence comprising SEQ ID NO: 6. In one embodiment, the primer comprises a nucleic acid sequence having at least 80%, at least 85%, at least 90%, at least 91%, at least 92%, at least 93%, at least 94%, at least 95%, at least 96%, at least 97%, at least 98%, at least 99%, or 100% identity to a nucleic acid sequence comprising SEQ ID NO: 31. In one embodiment, the primer comprises a nucleic acid sequence having at least 80%, at least 85%, at least 90%, at least 91%, at least 92%, at least 93%, at least 94%, at least 95%, at least 96%, at least 97%, at least 98%, at least 99%, or 100% identity to a nucleic acid sequence comprising SEQ ID NO: 32. In one embodiment, the DRED is selected from those diseases listed in Table 1 or Table 2.

An aspect of the invention provides for a method for treating a DNA Repeat Expansion Disease (DRED) in a subject in need thereof. In one embodiment, the method comprises administering to the subject an effective amount of a nuclease-resistant oligonucleotide compound as described herein. In one embodiment, the DRED is selected from those diseases listed in Table 1 or Table 2.

An aspect of the invention provides for a method for treating a DNA Repeat Expansion Disease (DRED) in a subject in need thereof. In one embodiment, the method comprises administering to the subject an effective amount of a pharmaceutical composition comprising a nuclease-resistant oligonucleotide compound as described herein. In one embodiment, the DRED is selected from those diseases listed in Table 1 or Table 2.

An aspect of the invention provides for a method for treating a DNA Repeat Expansion Disease (DRED) in a subject in need thereof wherein the method comprises administering to the subject an effective amount of an oligonucleotide complex described herein. In one embodiment, the DRED is selected from those diseases listed in Table 1 or Table 2.

An aspect of the invention provides for a method for treating a subject in need comprising administering a nuclease-resistant oligonucleotide compound that promotes the skipping of region(s) of a gene product. For example, the oligonucleotide comprises a sequence that specifically hybridizes in a human cell with a nucleic acid sequence encoding a subunit of the MMR system (e.g., MSH2, MSH3, MSH6, MLH1, MLH3, PMS1, or PMS2). In one embodiment, the nucleic acid sequence is a complementary sequence for a human MLH3 gene or gene product. In one embodiment, the nuclease-resistant oligonucleotide is useful for inducing exon skipping. For example, oligonucleotide(s) can induce skipping of MSH2 exon 1, 2, 3, 4, 5, 6, 7, 8, 9, 10, 11, 12, 13, 14, 15, 16, or a combination of MSH2 exons. Oligonucleotide(s) can induce skipping of MSH3 exon 1, 2, 3, 4, 5, 6, 7, 8, 9, 10, 11, 12, 13, 14, 15, 16, 17, 18, 19, 20, 21, 22, 23, 24, or a combination of MSH3 exons. Oligonucleotide(s) can induce skipping of MSH6 exon 1, 2, 3, 4, 5, 6, 7, 8, 9, 10, or a combination of MSH6 exons. Oligonucleotide(s) can induce skipping of MLH1 exon 1, 2, 3, 4, 5, 6, 7, 8, 9, 10, 11, 12, 13, 14, 15, 16, 17, 18, 19, or a combination of MLH1 exons. Oligonucleotide(s) can induce skipping of MLH3 exon 1, 2, 3, 4, 5, 6, 7, 8, 9, 10, 11, 12, 13, or a combination of MLH3 exons. Oligonucleotide(s) can induce skipping of PMS1 exon 1, 2, 3, 4, 5, 6, 7, 8, 9, 10, 11, 12, 13, or a combination of PMS1 exons. Oligonucleotide(s) can induce skipping of PMS2 exon 1, 2, 3, 4, 5, 6, 7, 8, 9, 10, 11, 12, 13, 14, 15, or a combination of PMS2 exons. In one embodiment, the oligonucleotide directs skipping of one or more exons of MSH2, MSH3, MSH6, PMS1, PMS2, MLH1, or MLH3. In one embodiment, one or more oligonucleotides can induce skipping of MLH3 exon 7. In one embodiment, the oligonucleotide is decreases the rate of DNA repeat expansion. In one embodiment, the oligonucleotide is useful in treating a DNA repeat expansion disease. In one embodiment, the target nucleic acid sequence is located on human chromosome 2, 3, 5, 7, or 14. In one embodiment, the target nucleic acid sequence (or target complementary nucleic acid sequence) comprises: a nucleic acid sequence corresponding to a region of interest for any one of the exons 1-16 described herein for GenBank Accession No. NG_007110.2, or to an intron-exon junction, or to an exon-intron junction listed with GenBank Accession No. NG_007110.2; a nucleic acid sequence corresponding to a region of interest for any one of the exons 1-24 described herein for GenBank Accession No. NG_016607.1, or to an intron-exon junction, or to an exon-intron junction listed with GenBank Accession No. NG_016607.1; a nucleic acid sequence corresponding to a region of interest for any one of the exons 1-10 described herein for GenBank Accession No. NG_007111.1 or SEQ ID NO: 33, or to an intron-exon junction, or to an exon-intron junction listed with GenBank Accession No. NG_007111.1 or SEQ ID NO: 33; a nucleic acid sequence corresponding to a region of interest for any one of the exons 1-19 described herein for GenBank Accession No. NG_007109.2, or to an intron-exon junction, or to an exon-intron junction listed with GenBank Accession No. NG_007109.2; a nucleic acid sequence corresponding to a region of interest for any one of the exons 1-13 described herein for GenBank Accession No. NG_008648.1, or to an intron-exon junction, or to an exon-intron junction listed with GenBank Accession No. NG_008648.1; a nucleic acid sequence corresponding to a region of interest for any one of the exons 1-13 described herein for GenBank Accession No. NG_008649.1 or SEQ ID NO: 1, or to an intron-exon junction, or to an exon-intron junction listed with GenBank Accession No. NG_008649.1 or SEQ ID NO: 1; or a nucleic acid sequence corresponding to a region of interest for any one of the exons 1-15 described herein for GenBank Accession No. NG_008466.1, or to an intron-exon junction, or to an exon-intron junction listed with GenBank Accession No. NG_008466.1. In one embodiment, the component of the MMR complex comprises MutS or MutL. In one embodiment, MutS comprises a subunit selected from the group consisting of MSH2, MSH3, and MSH6. In one embodiment, MutL comprises a subunit selected from the group consisting of MLH1, MLH3, PMS1, and PMS2. In one embodiment, MLH3 comprises SEQ ID NO: 1. In one embodiment, the oligonucleotide hybridizes to the target complementary nucleic acid sequence comprising SEQ ID NO: 2. In one embodiment, the oligonucleotide has at least 60%, at least 65%, at least 70%, at least 80%, at least 85%, at least 90%, at least 91%, at least 92%, at least 93%, at least 94%, at least 95%, at least 96%, at least 97%, at least 98%, at least 99%, or 100% identity to a nucleic acid sequence comprising SEQ ID NO: 3 or SEQ ID NO: 4. In one embodiment, the oligonucleotide has at least 60%, at least 65%, at least 70%, at least 80%, at least 85%, at least 90%, at least 91%, at least 92%, at least 93%, at least 94%, at least 95%, at least 96%, at least 97%, at least 98%, at least 99%, or 100% identity to a nucleic acid sequence depicted in Table 4. In one embodiment, the oligonucleotide comprises 15 to 30 nucleotide bases in length. In one embodiment, the oligonucleotide comprises one or more morpholino subunits, one or more locked nucleic acid subunits, one or more 2-O-methyl moieties, or one or more peptide moieties. In one embodiment, the subject in need is diagnosed with a repeat expansion disorder (e.g., a DRED). In one embodiment, the DRED is selected from those diseases listed in Table 1 or Table 2.

BRIEF DESCRIPTION OF THE FIGURES

The patent of application file contains at least one drawing executed in color. Copies of this patent or patent application publication with color drawing (s) will be provided by the Office upon request and payment of the necessary fee.

FIG. 1A shows part of a GAA•TTC repeat (SEQ ID NO: 41) depicted with the purine (or R) strand in red, and the pyrimidine (or Y) strand in yellow. The numbered bases show alignment in register. FIG. 1B shows that during transcription, the two strands are separated and a variety of structures can form. One likely example, an RNA•DNA hybrid, is shown. FIG. 1C shows resolution of a structure that can lead to an out-of-register re-annealing within the repeat. Figure discloses SEQ ID NOS 42 and 43, respectively, in order of appearance. FIG. 1D shows the small loop that is formed becomes a target for binding by mismatch repair complex, MutSβ. Figure discloses SEQ ID NO: 44. FIG. 1E depicts MutSβ in turn recruiting MutLγ, an endonuclease. Figure discloses SEQ ID NOS 44 and 43, respectively, in order of appearance. FIG. 1F shows that repeat expansion has occurred with the addition of two trinucleotides (*) after repair initiated by MutSβ and facilitated by MutLγ. Figure discloses SEQ ID NO: 42.

FIG. 2A is a representative gel image of PCR products measuring GAA•TTC lengths. FIG. 2B is a bar graph showing mean expansion rates. Compared to the empty vector control virus (pLKO) MLH1sh was significantly different (p=0.0009) as was MLH3sh (p=0.00045) whereas PMS2sh did not reach significance (p=0.053).

DETAILED DESCRIPTION OF THE INVENTION

Abbreviations and Definitions

Figure 1:
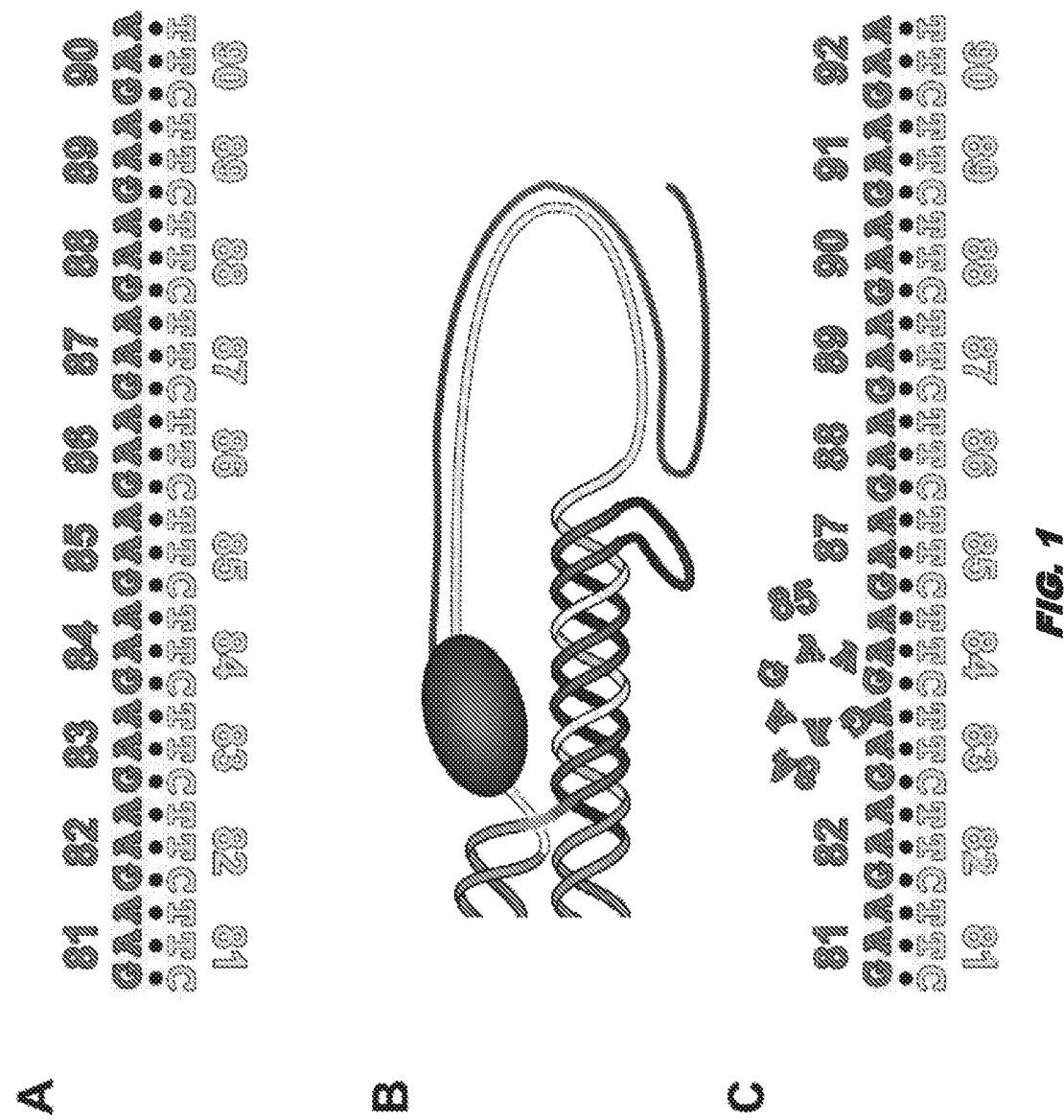
FIGS. 1A-F show a working model for transcription initiated DNA repeat expansion via mismatch repair.

The singular forms "a", "an" and "the" include plural reference unless the context clearly dictates otherwise. The use of the word "a" or "an" when used in conjunction with the term "comprising" in the claims and/or the specification may mean "one," but it is also consistent with the meaning of "one or more," "at least one," and "one or more than one."

As used herein the term "about" is used herein to mean approximately, roughly, around, or in the region of. When the term "about" is used in conjunction with a numerical range, it modifies that range by extending the boundaries above and below the numerical values set forth. In general, the term "about" is used herein to modify a numerical value above and below the stated value by a variance of 20 percent up or down (higher or lower).

The terms "animal," "subject," and "patient" as used herein includes all members of the animal kingdom including, but not limited to, mammals, animals (e.g., cats, dogs, horses, swine, etc.) and humans.

Repeat Expansion Diseases

DNA repeat expansion disorders are a family of genetic disorders characterized by the pathogenic expansion of a repeat region within a genomic region (1,2). In such disorders, the number of repeats exceeds that of a gene's normal, stable threshold, expanding into a diseased range. In most cases, the length of repeat expansion is negatively correlated with prognosis, i.e. longer repeats are correlated with an earlier age of onset and worsened disease severity. DNA repeat expansion disorders are often called trinucleotide repeat (TNR) expansion disorders because trinucleotide based disorders were the first discovered and are the most widely known form of expansion diseases. However, expansions of up to twelve base repeat units have been found to cause disease (see Table 1).

TABLE 1

Repeat Expansion Diseases

|    | Disease, repeat and gene affected | Estimated Prevalence |
|----|-----------------------------------|----------------------|
| 1  | Friedreich Ataxia (FRDA) GAA expansion in FXN | 2-4/100,000 (~1% of European descent carry) |
| 2  | Fragile X Syndrome (FXS) CGG expansion in FMR1 | 14/100,000 males |
| 3  | Huntington's Disease (HD) CAG expansion in HTT | 2.71/100,000 |
| 4  | Amyotrophic lateral sclerosis/frontotemporal dementia (ALS/FTD) CCGGGG expansion in C9orf72 | 24%-46% of Familial ALS |
| 5  | Myotonic dystrophy type 1 (DM1) CTG expansion in DMPK | 5/100,000 |
| 6  | Myotonic dystrophy type 2 (DM2) CCTG expansion in ZNF9 | 12.5/100,000 |
| 7  | Spinal & Bulbar muscular atrophy (SBMA) CAG expansion in AR | 0.75/100,000 males |
| 8  | Spinocerebellar Ataxia 1/ SCA1 CAG expansion in ATXN1 | 1.5/100,000 |
| 9  | SCA2 CAG expansion in ATXN2 | ? |
| 10 | SCA3/Machado-Joseph disease (MJD) CAG expansion in ATXN3 | ? |
| 11 | SCA6 CAG expansion in CACNA1A | 0.31/100,000 |
| 12 | SCA7 CAG expansion in ATXN7 | 2% of SCA's |
| 13 | SCA8 CAG expansion in ATXN8 | 2-5% autosomal dominant ataxias |
| 14 | SCA10 ATTCT expansion in ATXN10 | ? |
| 15 | SCA12 CAG expansion in PPP2R2B | ? |
| 16 | SCA17 CAG/CAA expansion in TBP | ? |
| 17 | SCA31 TGGAA expansion in TK2 | ? |
| 18 | SCA36 GGCCTG in NOP56 | ? |
| 19 | Dentatorubral-pallidoluysian atrophy (DRPLA) CAG expansion in DRPLA | 0.48/100,000 of Japanese population |
| 20 | Oculopharyngeal muscular dystrophy (OPMD) CGG expansion in PABPN1 | |
| 21 | Progressive myoclonus epilepsy (EPM1) CCCCGCCCCGCG (SEQ ID NO: 34) expansion in CSTB | 5/100,000 Finnish births |

The repeat expansion disorders that were discovered first are predominantly dominant diseases, such as Huntington's disease. However, recessive DNA repeat expansion disorders are a rapidly growing subclass. For example, the progressive, neurodegenerative disease Friedreich ataxia (FRDA) is caused by a repeat expansion in the FXN gene from the normal range of 6 to 36 repeats to the diseased range of approximately 600 to 1600 repeats (3). The GAA•TTC repeat expanded from an Alu element in the FXN first intron (4,5). Disease severity correlates to the length of the expanded repeats and the consequent reduction of FXN gene expression. Over a million Alu elements together constitute about 11% of the human genome (6), suggesting a vast reservoir for other such expansions. Indeed, the CCTG expansion responsible for Myotonic dystrophy type 2 (DM2) and the ATTCT expansion causing spinocerebellar ataxia type 10 (SCA10) also expanded from Alu elements (7,8).

To effectively treat a relentlessly progressive and lethal disease like Friedreich ataxia, the underlying DNA repeat expansion must be addressed. Currently there is no effective treatment and no cure for any of the DNA repeat expansion diseases (see Table 2). In one embodiment, the invention is directed to treatment of DNA repeat expansion diseases (DREDs) using oligonucleotide compositions discussed herein.

TABLE 2

Exemplary DNA repeat expansion diseases.

| | |
|---|---|
| Friedreich's Ataxia | Spinocerebellar ataxia type 3 |
| Blepharophimosis-ptosis-epicanthus inversus | Spinocerebellar ataxia type 6 |
| Cleidocranial dysplasia | Spinocerebellar ataxia type 7 |
| Congenital central hypoventilation | Spinocerebellar ataxia type 8 |
| Dentatorubralpallidoluysian atrophy | Spinocerebellar ataxia type 10 |
| Fragile X syndrome | Spinocerebellar ataxia type 12 |
| FRAXE mental retardation | Spinocerebellar ataxia type 17 |
| Hand-foot-genital | Spincocerebellar ataxia type 31 |
| Holoprosencephaly | Spinocerebellar ataxia type 36 |
| Myoclonus epilepsy type 1 | Huntington's disease like 2 |
| Myotonic dystrophy type 1 | Spinal and Bulbar Muscular atrophy |
| Myotonic dystrophy type 2 | Huntington's disease |
| Oculopharyngeal muscular dystrophy | Synpolydactyly |
| Spinocerebellar ataxia type 1 | Fragile X-associated tremor/ataxia syndrome |
| Spinocerebellar ataxia type 2 | Syndromic and nonsyndromic X-linked mental retardation |
| Amyotyophic Lateral Sclerosis/Frontotemporal Dementia Progressive myoclonus epilepsy | Dentatorubral pallidoluysian atrophy |

Sufficiently long DNA repeats such as those seen in DNA repeat expansion disorders are characterized by genomic instability of the repeated region. Often, the repeated regions frequently change in length during intergenerational transmission and within somatic cells. This fact holds both clinical and emotional relevance. Clinically, longer repeat lengths are associated with increased disease severity and earlier age of onset. Additionally, the progressive repeat expansion may actually cause development of the disease that otherwise would not develop, as the expansion of only 1 additional repeat can result in an individual's repeat region expanding into the diseased range. Emotionally, this possibility may result in increased anxiety and depression in the 'at risk' individual. Unfortunately, there are no therapeutics to slow disease repeat expansion.

DNA Mismatch Repair (MMR)

The molecular mechanism underlying repeat expansion largely remains unclear. Without being bound by theory, DNA mismatch repair contributes to the genomic instability observed in trinucleotide repeat expansion disorders. DNA mismatch repair (MMR) is a pathway that normally recognizes and repairs DNA errors made during replication. However, when it comes to certain types of repetitive DNA, MMR actually can contribute to genome instability. For example, a contribution by the MMR pathway has been established in several repeat expansion diseases including myotonic dystrophy, Huntington's disease, and Friedreich ataxia. For example, the inventors' laboratory has contributed to the understanding of the role of MMR in Friedreich ataxia. MMR requires the sequential action of the protein complexes MutS and then MutL. Humans have two different MutS complexes, alpha and beta, and three different MutL complexes, alpha, beta, and gamma. In human cells, DNA mismatches are initially recognized by a MutS protein heterodimer prior to recruitment of a MutL complex. MutSalpha, a heterodimer of MSH2 and MSH6, is the dominant MutS complex that recognizes base-base mismatches and short insertion/deletion loops. MutSbeta, a complex of MSH2 and MSH3, is less abundant than MutSalpha in most cell types, and appears to be functionally redundant to MutSalpha. In MMR, MutS heterodimers recognize a mismatch but a MutL heterodimer is required as the next step in the mismatch repair process. In humans there are four identified MutL homologues: MLH1, MLH3, PMS1 and PMS2 (9-12). MLH1 is the master subunit, much like MSH2 in the MutS system. MLH1 combines with PMS2 to form MutLalpha, with PMS1 to form MutLbeta and with MLH3 to form MutLgamma, respectively. Also like MSH2 and its partners, MLH1 and its partners are more stable as heterodimers (11). MutLalpha is the dominant species, being about ten-fold more abundant than MutLbeta (11), similar to the ratio between MutSalpha and MutSbeta (13). MutLgamma is less abundant still: about 2% the level of MutLalpha (14). MLH3 expression levels are considerably lower than the other binding partners of MLH1 and MLH3 is currently considered to be a minor player in MMR processes, as it has mostly redundant functions. Without being bound by theory, MLH3, while a minor player in canonical MMR, is a major force in DNA repeat expansion. In one embodiment, the present invention utilizes oligonucleotides (for example, antisense oligonucleotides resistant to nuclease digestion), for use in modulating the expression and/or function of subunits of the MMR system that are encoded by nucleic acid molecules discussed herein, ultimately modulating the amount of a MMR system subunit that is expressed and/or produced. In one embodiment, the MMR system subunit comprises MSH2, MSH3, MSH6, MLH1, MLH3, PMS1, or PMS2. In one embodiment, the MMR system subunit comprises MSH2, MSH3, or MSH6. In one embodiment, the MMR system subunit comprises MLH1, MLH3, PMS1, or PMS2. In one embodiment, the he MMR system subunit comprises MLH1 or MLH3. In one embodiment, the MMR system subunit comprises MLH1. In one embodiment, the MMR system subunit comprises MLH3. In one embodiment, the MMR system subunit comprises PMS1. In one embodiment, the MMR system subunit comprises PMS2. In one embodiment, the MMR system subunit comprises MSH2. In one embodiment, the MMR system subunit comprises MSH3. In one embodiment, the MMR system subunit comprises MSH6. In one embodiment, the expression and/or function of a subunit of the MMR system is decreased.

The genomic sequence for human MSH2 (found on human chromosome 2) has GenBank Accession No. NG_007110.2. Sequence information related to human MSH2 (isoform 1) is accessible in public databases by GenBank Accession numbers NP_000242.1 (protein) and NM 000251.2 (nucleic acid). Sequence information related to human MSH2 (isoform 2) is accessible in public databases by GenBank Accession numbers NP_001245210.1 (protein) and NM_001258281.1 (nucleic acid). The genomic sequence for human MSH2 (GenBank Accession No. NG_007110.2; 166,188 bp in length), is found at nucleotide no. 4,944 and terminates at nucleotide no. 85,105, wherein exon 1 is located between nucleotides 4,944 and 5,279; exon 2 is located between nucleotides 10,278 and 10,432; exon 3 is located between nucleotides 11,971 and 12,249; exon 4 is located between nucleotides 14,291 and 14,437; exon 5 is located between nucleotides 16,146 and 16,295; exon 6 is located between nucleotides 18,173 and 18,306; exon 7 is located between nucleotides 31,619 and 31,818; exon 8 is located between nucleotides 47,425 and 47,534; exon 9 is located between nucleotides 64,908 and 65,031; exon 10 is located between nucleotides 68,535 and 68,685; exon 11 is located between nucleotides 72,842 and 72,939; exon 12 is located between nucleotides 76,902 and 77,147; exon 13 is located between nucleotides 78,244 and 78,448; exon 14 is located between nucleotides 80,149 and 80,396; exon 15 is located between nucleotides 82,573 and 82,748; and exon 16 is located between nucleotides 84,656 and 85,105. It is understood that intron sequence precedes and follows the denoted nucleotide regions comprising the exon sequences listed herein. Oligonucleotide compounds (e.g., exon skipping or intron retaining SSOs) can be directed to the nucleic acid sequence corresponding to the region of interest for each of the exons 1-16 described herein, and intron-exon junctions, or exon-intron junctions listed with GenBank Accession No. NG_007110.2.

The genomic sequence for human MSH3 (found on human chromosome 5) has GenBank Accession No. NG_016607.1. Sequence information related to human MSH3 is accessible in public databases by GenBank Accession numbers NP_002430.3 (protein) and NM_002439.4 (nucleic acid). The genomic sequence for human MSH3 (GenBank Accession No. NG_016607.1; 229,341 bp in length), is found at nucleotide no. 5,174 and terminates at nucleotide no. 227,341, wherein exon 1 is located between nucleotides 5,174 and 5,490; exon 2 is located between nucleotides 6,937 and 7,057; exon 3 is located between nucleotides 15,669 and 15,889; exon 4 is located between nucleotides 20,623 and 20,835; exon 5 is located between nucleotides 22,770 and 22,886; exon 6 is located between nucleotides 23,267 and 23,384; exon 7 is located between nucleotides 25,509 and 25,654; exon 8 is located between nucleotides 29,453 and 29,619; exon 9 is located between nucleotides 75,979 and 76,091; exon 10 is located between nucleotides 79,377 and 79,491; exon 11 is located between nucleotides 91,990 and 92,074; exon 12 is located between nucleotides 95,032 and 95,141; exon 13 is located between nucleotides 112,072 and 112,204; exon 14 is located between nucleotides 118,459 and 118,646; exon 15 is located between nucleotides 119,361 and 119,529; exon 16 is located between nucleotides 126,220 and 126,284; exon 17 is located between nucleotides 129,246 and 129,362; exon 18 is located between nucleotides 138,091 and 138,198; exon 19 is located between nucleotides 143,259 and 143,370; exon 20 is located between nucleotides 164,110 and 164,267; exon 21 is located between nucleotides 204,656 and 204,842; exon 22 is located between nucleotides 215,339 and 215,468; exon 23 is located between nucleotides 223,642 and 223,813; and exon 24 is located between nucleotides 226,277 and 237,341. It is understood that intron sequence precedes and follows the denoted nucleotide regions comprising the exon sequences listed herein. Oligonucleotide compounds (e.g., exon skipping or intron retaining SSOs) can be directed to the nucleic acid sequence corresponding to the region of interest for each of the exons 1-24 described herein, and intron-exon junctions, or exon-intron junctions listed with GenBank Accession No. NG_016607.1.

The genomic sequence for human MSH6 (found on human chromosome 2) has GenBank Accession No. NG_007111.1. Sequence information related to human MSH6 (isoform 1) is accessible in public databases by GenBank Accession numbers NP_000170.1 (protein) and NM_000179.2 (nucleic acid). Sequence information related to human MSH6 (isoform 2) is accessible in public databases by GenBank Accession numbers NP_001268421.1 (protein) and NM_001281492.1 (nucleic acid). Sequence information related to human MSH6 (isoform 3) is accessible in public databases by GenBank Accession numbers NP_001268422.1 (protein) and NM_001281493.1 (nucleic acid). The genomic sequence for human MSH6 (GenBank Accession No. NG_007111.1; 30,807 bp in length; SEQ ID NO: 33), is found at nucleotide no. 4,936 and terminates at nucleotide no. 28,807, wherein exon 1 is located between nucleotides 4,936 and 5,347; exon 2 is located between nucleotides 12,781 and 12,977; exon 3 is located between nucleotides 17,748 and 17,917; exon 4 is located between nucleotides 20,465 and 23,009; exon 5 is located between nucleotides 25,274 and 25,539; exon 6 is located between nucleotides 26,764 and 26,881; exon 7 is located between nucleotides 27,472 and 27,561; exon 8 is located between nucleotides 28,058 and 28,212; exon 9 is located between nucleotides 28,306 and 28,505; and exon 10 is located between nucleotides 28,633 and 28,807. It is understood that intron sequence precedes and follows the denoted nucleotide regions comprising the exon sequences listed herein. Oligonucleotide compounds (e.g., exon skipping or intron retaining SSOs) can be directed to the nucleic acid sequence corresponding to the region of interest for each of the exons 1-10 described herein, and intron-exon junctions, or exon-intron junctions listed with GenBank Accession No. NG_007111.1 or described in SEQ ID NO: 33.

```
SEQ ID NO: 33 (exon sequences are highlighted and bolded therein):
    1 cactatgttg ctagctggtc ttgaactcct ggcctcaagt catccttctg tcttggcctc 61 ccaaagtgtt gggattgtaa gtgtgagcca ctgtccctgg ccagttggtg atttatttgt 121 ataactgtcc aatttattga atacgtatgg cgtgccaagc actgggctga gggcttcata 181 atgcccttc  actcaatgct tagcacaacc catgaagaag gtagtgttaa tatcatccct 241 gttttacaga tgtagaaact gaggcacagg ctaaataact tgcccaacaa gctcgtgcag 301 tttagtaagc agctcagctg ggatgtgaac acaaactttg aatacagagc tcttaaccag 361 taggccagag gttcccaaac acctagtata tttactacct tagtactttc ctgccacatc 421 tcctaggcca aaacaactcc attgattgtt atgcaattta ctaagtgtag ccatttgaaa 481 aaaaaataca tataaaagaa aaatattttt attcagtttt caaaataacc catatatagt 541 catggaatgt atgtgttggt tgggcactgc agactaaaga cagtttaggg ccgggcacgg 601 tggctcaggc ctgtaatcct agcactttgg gaggccaagt agagagaagg gcttgagccc 661 aagagttgga gaccggcctg ggcaacatag caagacccag tctctacaga aaataaaatt
```

-continued

```
 721 atcagggtgt gaggacgcac acctgcagtc ttagctgctt gggaggctga ggctggagga
 781 tcagcctggg caacagagtg agaccctgtc tcagaaaaaa aaaaaaaaaa agacagactt
 841 ttattcagat atgcatgcag gagttcacag aaaaaaaaag tgagtccagg aggctgttat
 901 ttggcattta tacaactttt tttttcttga atctcgaaat ctactttata tataccattt
 961 aataggggaa gaggagggag aaaaagcctt ccatgggaag aacaaatagg tttctgggg
1021 aacaaaaggg agataagaat gtttgttttt gcaggtgcaa gtggtctttg tctttttttc
1081 tggccactaa aactcccta gagaggagat ttacggcagc ttcactccca gaaatttctg
1141 ctgttagtcg cataagggaa gctttgaaac ggcatctttc tgcatctgtt ggctctcaaa
1201 tgtcttcagt tccaagtaac attcatgcca attctggggg tctgagtgtc cccacataat
1261 acatgtgttc tcttgtcttt taatgaagtt tgtgggaggc atctaactgt agcctccaaa
1321 atttggccca taggtactac tgtccttatc aaagacgagg aaacaagttc agaaaagtat
1381 taattgctcc gagttatctg cttggctagc taggatcaga gctcagttct ccatttaacc
1441 caaagcccag gctcttaacc tcttacaact ggcgcatccc ctctgaacct ccatttcctc
1501 cctgtaaaag aataacatcg gccgggcgca gtggctcaca tctataatcc cagcactttg
1561 ggaggcagag atgggcggat cacgaggtca ggagtttgag accagcctgg ccaacatggt
1621 gaaacccat ctctactaaa aatacaaaac ttagctgggt gtgttggtgc ctgtaacccc
1681 agctactcag gagactgagg caggagaatt gccttaacct gggaggcgga ggttgtggtg
1741 agccaagatc gtgccattgc actccagcct cggtgacaga gcaagactcc atccccaaaa
1801 aaacaaacaa caacaacaaa aagagaataa cgttatattc agttgaacca aaatgaatta
1861 aatattaata tttgtacttc aaaaacggtc cagcttggct gggcgcagtg gctcccgcct
1921 gtaatcccaa cattttggga ggccgaggca ggaggatcat tgaggtcag gagtttgaga
1981 ccagcctggc caacatggtg aaatcctgtc tctactaaaa atacaaaaat tagctgggca
2041 gtagtagcgc gtgccggtaa tcccagctat tcaggaggct gaggaaggag aattgcttga
2101 gcttgggagg tgaaagttgt ggtgagctga gactgcacta ctgcacacca gtctgggaga
2161 cagagtaaga ccctgtctca aaacaaaaca accaaaaaac caaaaggtc cagcttgggc
2221 aacatagtga aacttcgtct ctacagaaaa ttttttaaaat actagcaggg caccgggcac
2281 agtggctcat acctgtaatc ccagcacttt gggaggctga ggcaggcggg tcacttgtgg
2341 tcaggagttt gggatcaggc aggccaacat ggtgaaaccg tgtctctact aaaaaacaaa
2401 aattagctgg gcatggtggt aggcaccagt aatcctagca ctcaggaggc tgaggcatga
2461 gaattgcctg aacccgcaaa gcaggggttg cagtgaacca agatggcgtc actgtactcc
2521 agcctgggtg acagaataag actcctcaat taaaaaaaaa aaaaattagc tgggcatggt
2581 gttgcgggcc tgtggtccca ggtactcagg aggctgaggt gagaggatta cttaagcctg
2641 ggaggttgag gctacagtaa gccaagatca cgccactata ctccagcctc tgtgacagag
2701 ccagaccctg tctcaaaaaa attttaaaaa gggcaaattt tggcaatttc acatagttca
2761 acctagtata aggtggttgt aataactaaa tgagataaaa tggtgttaaa ttggaagtat
2821 tatagtattt ctgttaacaa catagggctc cagaaccagc ttccttgagt ttaaatccag
2881 gctccaccac ttcctagcta tgcagtcatg ggcaagttac ttgacccaac tgtgcctcag
2941 cttcatccat gatatggaga tacaggataa ccagcctctt acgtgcaatt ctgaaatcca
3001 aaaagctctg taaaccaaaa gtttggggt aaactcattt ggtagcaaat tttgacctga
```

-continued

```
3061  ggctatttat agtctatatt ctgtattctt tctacttagt atgaataagc atgtaagttt
3121  tactgcatgt ttgatttcag catgttcccc cagactctct gggggtgttt acgtatgccg
3181  gtgggggaaa gagaccaact ctcaaatatt atctcaaaca gttggtttca ctgtgcttgc
3241  ttgggtagca catataccaa aattggaatg acccctgcac agggatgaaa tgcaaattcg
3301  tgaagcatac tgtattttc ttagcacata ccacctttgg caatattctt ttttttttt
3361  tgagagggag tcttgctctg tcgcccaggc tggagtgcag aggcgcgatc tcggctcact
3421  gcaagctccg cctcccgggt tcacaccatt ctcctacctc agcctcccca gtagctggga
3481  ctacaggcgt gtgctaccac gccaggctaa ttttttgtat ttttagtaga ggcggggttt
3541  cactgtgtta gccaggatgg tctcgatctc ctgacctcgt gatccgccca cctccgcccc
3601  cccccgaag tgccgagtgc tgggactaca ggcgtgagcc actgcgcccg gccccgcct
3661  tttttttta gattgatttt attacttgcc tagcaaagga gaaccttctg gcagaacagt
3721  ctccaagaac aaggcaaaca actaatttta cataggtttt taccaatgta cagctgttga
3781  ttgtgactgg tttccggcaa tctggatttc acaatctgga taaggggaca aacaattgtc
3841  tgtcttccac tatctttctt gaatttgaat agaacctttt tattctcata gcctcttagc
3901  tttctttctt ttttttttga gacggagttt cgctcttgtc gcccaggctg gagtgcagtg
3961  gcgcgacctt ggctcactgc aaacgctgcc tcccaggttc aagttattct cctgcctcag
4021  cctcccaagt agctgggatt acaggcgcat gccaccacgc ccggctaatt tttggatttt
4081  tagtagagac gggggtttca ccatgttgac taggctggtc ttcaacgcct gacctcaggt
4141  gatccgcccg cctcggcatc ccaaagtgct gggattacag gcgtgagcca ctgcgcccgg
4201  cctctcatag tctcttagct ttctaaaatt tgaaaatcc tgtaaagaca cacctgggtc
4261  aaagggctca gataacggac tgtggcccctt aagtacttac gtcacaggtt attgagagga
4321  tcgatttagt taccagatgt aaaatgctgg gatcagtgcc tggcaaagga aaactttgta
4381  cagctgcagg ctttcaccat acacaacagc atcgctaacg aatgctatta caatattcat
4441  ttagcgttta ccaagtgcct actctataca aatcttgaga atacaacgtg aaggtgaact
4501  gctgactaaa gtttggtccc tttcgctccg tctccttgcg aaaatgctct aacggcagga
4561  ggtcacgcga gcgctggacg cgtttctccc cgcgagcccc tttccgaggc ctttcgggtc
4621  ccccggtta tccccgcccg ggcggtgcgc gccccgctg ttcccgcttc cgctccagag
4681  aggcagggct ttccgagcct gctagccccg cggccgcaac taaccccggg tcggagtgtt
4741  ccggcccggc cagccccgcg gcgtgaggga aggggagctc agcagttccc cgcgcggggc
4801  ccaggcgtcg gcggcagggc gggcccctca ccgccagcgt gccagcccg ccctaccca
4861  ccagtgtgcc agccccgccc ttccccacgt cgccgcgcgc ccggggggcgg ggcctggcgc
4921  gcaccgcccg cgcacggcga ggcgcctgtt gattggccac tggggcccgg gttcctccgg
4981  cggagcgcgc ctcccccag atttcccgcc agcaggagcc gcgcggtaga tgcggtgctt
5041  ttaggagctc cgtccgacag aacggttggg ccttgccggc tgtcggtatg tcgcgacaga
5101  gcaccctgta cagcttcttc cccaagtctc cggcgctgag tgatgccaac aaggcctcgg
5161  ccagggcctc acgcgaaggc ggccgtgccg ccgctgcccc cggggcctct ccttccccag
5221  gcggggatgc ggcctggagc gaggctgggc ctgggcccag gcccttggcg cgctccgcgt
```

```
5281 caccgcccaa ggcgaagaac ctcaacggag ggctgcggag atcggtagcg cctgctgccc 5341 ccaccaggta gcggggtggg ggtggggtcg aaggcggggg catagcggcg gggcgcttgg 5401 aacccggcga ggggaggctc gcacaggggg ttgggggggt gcacggcctg gccctgggct 5461 cggaggaggc ggggccgcag agttggcttg aatgagtgca ggggtcgagt ctggagcatt 5521 tgggggtgta gcttgtaaac agggtcggag gagagaggct gtgcaggaag agggctgcag 5581 gggagacgcg gagagttcgg gccttttgga gggaggagac gcgtcccgcc aggtgggggt 5641 gctgggctaa ggaaggggcg acgcgcgcag ctccgggtgg ggaggggcc tgggaggtgg 5701 gagcactggg ggtggggcga aaggggaag gcgcccggcc cacttggtgg gcggggcggg 5761 gggcggggtg gcgggaagga ggaatgcctg cggaggccg aacggggaga gtccggtggt 5821 gtggggtgcg aaaggaggtt cctcggccgg cgcggagata gtgagttggg gctccagtag 5881 tcgatcgagg tagacactta gaggtagtta agagccgcgg tcgccgagac gccttgggga 5941 cggtgggcct tcggcctagg tgaggggccg ccgagggggt gggccacgag ctgcgagcgc 6001 ggggggggtgt gtcaccatgg ggaccgcggg gcctaattgg gcggggcggg gccgtgggga 6061 gccgaagtgc tgggatccgg ctgggtcctt cggtaggtag gctgcacgtg caccgagacg 6121 aagatagaat attttgacgt atgtggaaat tcgtgtcgag tggaaaatat tttattttat 6181 gaaatagtgt aattttttatg gggcaccact gggcttttag aggccttaat cgggcgctgg 6241 acaaagatgt gtggacgtga gtgactccgg ggaagcctgt cgggagttgt cctcacttta 6301 tgggcagtta agtgcttttt tttttttttc cttttttgaga gagagtttcg ctcaagtcca 6361 ggctggagtg caatggcgcg atctcagctc accgcaatct ccgcgtcccg gcttcaagcg 6421 attccccagc ttcagcctcc cgagtagtcg ggattacagg aatgcgcccc cacacccgc 6481 caatttgta tttttagtag agacggggtt tctccatgtt ggtcaggcta gtctcggaat 6541 tcccgacctc aggtgatcca cccgcctcgg cctcaaagtg ctgggattac aggcgctagc 6601 caccgcgccc ggtctgttta gggctttta tccgggcagc tggcgacatt ttgaaaagct 6661 tgcttttgct gtttgccaga tacatatata tgtattttga dacagagtct tgctcttttg 6721 tccaggctag agtgcagtgg cgcgttcttg gctcaccaca acctctgtct ctggatcaag 6781 agattatcct gcctcagcct cccaagtagc tgggactaca ggtgcgcccc accacgcctg 6841 gctaatttt gtattttttag tagagacggg tttcactatg ttggccaggc tggtatcgaa 6901 ctcctgacct cttgatcggc ccgcattggc ctaccaaagt gctgggatta caggcatgaa 6961 ccaccgagcc cggccgtttg tcagatacta aacacaaagt ttaatggtcg ctatttgaac 7021 aaacgaagaa ataaaggctc agaaaaaata actcattcaa gataagagcc agttcgtgtt 7081 ttttgtttgg ttttgttttg aaatggagtc tcgctctgtc gcccaggctg gagtgctgtg 7141 gcgctttctc ggctcactgc aacctctgcc cgccgggttc aagtgattct cctgcctcag 7201 cttcccgagt agctgggatt acgggtgtgc ccaccgcggt ccggctgatt tttcaccatg 7261 gagtttcacc atgttggcca ggctggtctt gaaactgctg acctcaagtg tccacccac 7321 ttcagcctcc caaagtgctg ggattacagg tgtgagccac cgtgcccggc cgctagttag 7381 tggttttgag taatggattt caaatccatt taaatccagt ttaaagtgtc ctaaaggaat 7441 tctgagattt ttctaagtgt aattatagtg ttacccttgt ttaagcgacc cttttcccgca 7501 gtttaaatat atatagttgt gcattagtag aaatatgcttg tggggaacag agccagcatc 7561 cgcaataaca aactcctggt tagaaaagca tgacgtattg tttacttgag catgaattga
```

```
-continued 7621  ttgttgaatc caaaccaaac gggtgtattt attgtaagga tgtactttac attcatattg
7681  aatagcgtat gttatttgtt tcttgaggtt gagtttaaga gacttgtaaa aataaaacgt
7741  atacatttca cctcccgtta tggagaggat tccagggtat tcaagaaaga tgggcatttg
7801  atactaggtt tctaaagaaa ctgcagtgtc tagatcactc tgccgagcac agcattaggc
7861  attatggatc ctggatacaa ccatgaacag gacaaagcaa agaggcaatt gtagactcca
7921  agtggaaagg ggacggagag gatgcgggtc aggctaggct ctcagctctg taaaccgaaa
7981  ccagaaggac aaataagctt agacagatta tagtgagagt gggaagctgg ttcaggaaga
8041  ggaaggtctg caaattgtgg gtaggatgaa aggaggagga gggagcattg gagaagttaa
8101  gcagagatcc aatcatgaac agtctgatga gctacagaga cattcggact tactccatga
8161  atcatttaag ccttaaaaca tgttgagcgt attttttttt ttttgagac ggaatttcac
8221  tcttgttgcc caagctggag tgcagtggtg tggtctcagc tcactgcaac ctccgcctcc
8281  tgggttccag cgattctcct gcctcatcct ctcaagtacc tggtattaca ggtgcctgcc
8341  accacgccca gctaattttt gtgtttatag tagagacggg tttcaccatg ttggtcaggc
8401  cagtcgtgaa ctcctgacct caggtgatcc acccacctca gcctcccaaa gtgttgggat
8461  tacaggcgtg aaccaccgca cctggccgtg agccaccgtg tctgtccgag catcttttaa
8521  tgtttgtcat ttagatttct tcttgtgctg aagtgtttgt cttttgctgt ttcttttttt
8581  tttcctagtt ctttgtcatt tgtgtgtgat ataaatgtct tctttcacaa tgagttcttt
8641  catttagttt atggctttgt tgttgttgtt gaataataga ggtctcactt tgttgcccag
8701  gctggtgttg aactcttgct ctcaagcgat cctcccactt cagcctccca acctgttggg
8761  attacaagtg tgagccacca cacccagcct tatggcatct ttcgatgaac aaattattga
8821  ttataatgtg gaatttgtcc ttttattttc tctgtggtta gtgtttctat aggttttatt
8881  taagaaatcc acagggaggc tgggtgcagt ggctcatgcc tgtaaaccca cactttggg
8941  aggccaaggc aggccaacat ggctagaccc tgtctctcca aaaataaga aaattagcca
9001  ggcatggtgg cgtgtgcctg tagtcccagc ttcttgggag actgagatgg gaggatcgct
9061  tgagtccagg aggttgaggc tgcagtaagc caagagatca tgccatgcac tccagcctgg
9121  gtggcagagt cagaccctgt ctgccaaaaa ataaaataaa agttggtgaa aatgttgatt
9181  atatatttta ggaacaacta gtaattgaca tcaaaattat gggctaaaga gaaagcaaaa
9241  ataatgtgat tttaaaccag aattcaaaag atctgtttag cgtatgttta gacaaagcca
9301  ttacttatta tatcaaagtt ttaacattta ttttgtgagc tgtcagcttt tcctcttaac
9361  attttttcccc accgtcttaa aaaacccaa gaataccgga catttaagac tcacttaaag
9421  ctttaaaagc acttgcaaaa tcctaaaatc ataatttaag gtgttttttgg agggcaggag
9481  caatggtggc aggcagtgtt ttgctttgtt gcccaggctg aagtacagtg gcagatctcg
9541  gttcactgca ccctcgacct attcggctca agtgatcctc ccacctcagc tttctgagta
9601  gctgggaccc caagtgcaca ccaccccatg cctggctaat ttttaaattt ttttgtagaa
9661  acaaggtctc actgtgtagc ccagatggtc tcgaattcct gggctcttaa gagatcctcc
9721  caaagtgctg ggatcatagg tgtgagccac cacacctggc ctattttggc attcttgaaa
9781  accgcaggat taccacggat aaaatttaa aattaccttt aaagaattca ggtttacaca
9841  caaaaaaaat ttggtttgtt agcagtgagt gaagaaaaat tttgagaaat gtttaaaatt
9901  tttagttttg ttacacaata cattttacta cctgtttaat tatctttttt gactcagaaa
9961  ccagtttcct gggtccagga tgtttagtgg tactcttttt cttcaagctt tttagcattg
```

```
10021  gaggaactgc atattagtaa aattttagt cttagcattt tatagcttac tgctatttct
10081  tttctttcat tctttctttc tttttttttt tttttttttt tttttttgaga tggagtctcg
10141  ccctgtcacc caggctggag tgcagtggca cgatctcggc ttactgcaac ctctgccttc
10201  caggttcaaa tgattctcct gcttcagcct cccgagtagc tgggattaca gatgcccgcc
10261  accatgccca gctaattttt atttttttag tagagatggg gtttcaccat gttggccagg
10321  ccagtctcga actcctgacc tcgtgatcaa cccgccttgg cctttcaaag tgctgggatt
10381  acaggcgtga gccaccgtgc ccagcctttt tcttttttctt tttctttttt tttttttttt
10441  tgagacggag tcttgctctg ttacccaggc tggagtgtag tggcatgatc tgggctcact
10501  gcaacctcca cctcccgggt tcaagggagt ctcctgcttc agcctcccga gtagctggga
10561  ttacaggcgc ctgccaccat gcccagctaa ttttgtatt tttttagtag atgggggtt
10621  tcgccatgtt ggccaggctg gtcttgaact cctgacctca ggtgatctgc ctgcctcgtc
10681  ctcccaaaat gctgggatta taggagtgag ccactgcgcc cggcccagca tactgctatt
10741  tctttctttc tttcttcttc cttttttttt ttttgtttt tttttttttt tttttttttt
10801  tgtgagacgg agtctgtcgt ccaggctgga atgcagtggc gttttcttgg ctcactgcaa
10861  cctctgctgc ccgggttcaa gtgattctcc tgcttcaggc tcccaagtag ctgggattat
10921  aggcctctgc cactgcactt ggctaatttt tgtattttg gtagagacgg ggtttcacca
10981  tcttggccag gctggtcttg aactcctgac ctcgtgatcc acctgccttg gcctcccaaa
11041  gtgctgggat tacagacctg agccaccgca cccggcccat actgctattt cttaacagca
11101  gagaaattat gtgtcagatt ctgtaagtgt aatggtatat aaaggataaa atgatgttga
11161  aaaacaaaat ttttgttta aatgcttatg tttctaatat tttatttcag aaaggaattt
11221  atttcaaaac tgataatggt tggatccagc ttttcacaca aacttttttt tcctagtgag
11281  gatgcacatt tatcctgtaa acaaatggaa gacattattt ttttaattgc ttgcttagaa
11341  atgaaataat tcttttctaa tgatctttta aagcatgaga cctcatacat catttaaaac
11401  aatttatact gtattttaca catgacaaag ttctaaggta acagccctt tctaagacta
11461  aagttacagt cctcccttg tatctgaggg ggattggttg caggacccc ctgtgaatac
11521  ccaaatcctt ggatgtccaa gtcccttatg agatgtagta tttgcatata acctatacac
11581  atcttcccct gtactttatc tctagattac gtacaatacc taatagaatg taaatgcttt
11641  gaaattagtt gttcagctgt attttaaatt ttgtattttt tttccttttt ttttgagaca
11701  gagtcttgct ctgttgccca ggctggagta cagtacagtg atcacagctc actgcacctt
11761  taacctccca ggctcaagct gtcctgcctc ggcctcccca agtgttggga ttacaggtgt
11821  gagccatcat acctggtcac tgttttttat tggttttaaa tttttgattt aaaatttta
11881  atctaggttg gttgaatctg gactggaacc caaggatatg tttgttgagc atactgtatt
11941  tactttggaa tacaactaga atgcttaact tgtatgttaa aaatacttta tttggccagg
12001  cgcggtggct cacgcctgta atcccagcac tttgagaggc caaggcgggt gaatcatttg
12061  aggtcaggag tttaagacga gcctggccaa catggcaaaa ccctgactct acaaaaaaaa
12121  ggtaaaaata agccaggtgt gatggcgtgt gcctgtagtc ttggctattc aggaggctga
12181  gacacaagaa tcgcttgaac cggggaggca cgttacgccc tcagttgttg acttgagttt
12241  ttccgtagtt tgtagggga gggtaataga gtattaggta gcttttggaa tacataggag
12301  tgtaactgga aaaagattcc aagcaagtct aatgaattag ataatttacc taattagtaa
```

```
12361  attatgtaat cagtatgctt tataataata ttgtgagtta gatcctgttt ctgatatgta
12421  cataccatat tgtataggtg ctactaattt ggagagcata tacagtgagt ccatgccttt
12481  ttcctgccat cagcattata ccaaaattct gccatggttt ttaaactttg attctgagaa
12541  agtttctcac cctaataaca taactatatt tgtgtttgtc ttcatagtta aatatgcatt
12601  atgatatcag cttgcataca tttttttaaat gacttgaata tctgacttta aaaattattc
12661  tagaatttct gtgcttcaat attaatgcca gaagacttgg aattgtttat ttgtaggtaa
12721  ctgcctttaa ggaaacttga ccaaatatta actaagttat gtatttcctt ttggcaacag
12781  ttgtgacttc tcaccaggag atttggtttg ggccaagatg gagggttacc cctggtggcc
12841  ttgtctggtt tacaaccacc cctttgatgg aacattcatc cgcgagaaag ggaaatcagt
12901  ccgtgttcat gtacagtttt ttgatgacag cccaacaagg ggctgggtta gcaaaaggct
12961  tttaaagcca tatacaggta agagtcacta ctgccatgtg tgtgtgtttg tgtgtgtgtg
13021  tgtgtgtgtg agagaaacag acagacaggc agacttttt ctatatgatg aaattaagtg
13081  tattttaccc cagtaaattg caaggggtgg cagttgtgaa agcttctggc atgggaaagg
13141  gatgtaacat ggtctttagc tggtttgttt tgtggaatgg aatttttatt tctgtcccttt
13201  gagtgactta cagcaatatt ataccttaa taagggtaaa ctaaactgtc cccccatctt
13261  gaagggtcca agagaaagtt aatgtcatca ggatacatag cctatagata gcgacattct
13321  ctagggaaag atggagatgc gcactacctg gccttcaaac tactcactaa tgaacacatc
13381  tgagttgagt ttcacaccaa actcctggaa ccataacttt cttttcccag atctagtctt
13441  gtttatcaca gacatcaaca gcctggcatg tttagcctca cttgggctag gtgcacccca
13501  tcgtctcttg tacaagttct ctttctttct tttttttttt ttttttttctg gagacagagt
13561  ctcactctgt tgcctaggct ggagtgcagt ggcgcaatct cggcccactg caacctccgt
13621  ctcctgggtt caagagtttc ctacctcagc ctcccgagta gcttgggatt ataggcacac
13681  gccacgttgc ctggctatat atatatattt tttttttgag acggagtttt gctcttttgg
13741  cccaggctgg agtgcaatgg cgcaatctca gctcactgca accgccacct cccgggttca
13801  ggtgattctc cttcctcagc ctctaaagta gctgggatta caggtgcaca ccaccaagcc
13861  cagctaattt tttatttcta gtagagatgg gtttcacca tgttggccaa gctggtcttg
13921  aactgctgac ctccagtaat ccacccacct cccctacca aagtgctggg attataggcg
13981  tgagccactg tgcccagccg cccagctaat ttttgtattt ttagtagaga cggggtttca
14041  ccatgttggc caggctggtc tccaacttct gacctcaggt gatctgccca tttcggcctc
14101  ccaagagtct ccagtctagt acgttgtcgt actcggtgtt gtaaaatcca aacaagggtc
14161  agtttcccag gtaactggga aattcccaga atcacactct ttcgtcatag tgctcatcct
14221  acaaaaaagg attgggggca ttttgtctaa aattaaatgt aaatggtgat ctgacataca
14281  ggtggaaaga gaattgggaa gttttgttct ctcttctacc aacttgccac ataatcttgg
14341  ccaagcaaag taacttgttt tttctttaa tctttttaaa agaaatagag acacagtttt
14401  gccatgttgc ccaagctggt ctcaaactcc tgcctgagct caagcagtct gcccacttcg
14461  gcctcccaaa gtgctgagac tacaggcata agccaccatg cccctgggct cggccaactt
14521  tttcgttttc ttttcaagag atgggggtct cactctgtca cccagcctgg agtatagtgt
14581  tgggatcata gctcactgga gccttgaact cctgggctca agtgattccc ccctgtttta
```

```
14641  gcctcctcag taaccgggac tagaggtgtc tgccaccaca cctggctaat ttttatatag
14701  tttttttttt tttttttttt ttttaaagag atgacggtct tgctatgttg ccccagggt
14761  ggtcttgaat tcttggcctc cagtgatcct tctgcatcag gctcccaagt agttgggtga
14821  tctggctaaa gtaacttatt ttctgatact gtttacttat atttagaatg aatctcattg
14881  gggttgcact ggggccgggc atggtggctc acacctgtaa tcccagcgct ttggaaggcc
14941  aaggcaggtg gatcacctga ggtcaggagt tccagactag cctggcaaac atggtgaaat
15001  cccgtctcta ctaaaaatac aaaaattagc tgggcatggt ggcacatgcc tgtaatccca
15061  gctacttggg aggctgaggc aagagaatcg cttgaatcta ggaggcggag gttgcagtga
15121  gtcaagatca tgccaccgca ctccaacctg ggtgacagag cgagactgtc tcaaaaaaaa
15181  aaaaaaaaaa aaaaaaaaaa aggctgggca cggtggctcg cgcctgtaat cccaacactt
15241  tgggaggccc aggcgggtgg atcacgaggt caggcgttcg agaccagcct gaccaagatg
15301  gtgaaacact gtctctacta aaatacaaa aataagctga atcccagct actcgtgaag
15361  ctgaggcaga gaattgctta aacctggtag gcggaggttg cagtgagccg agatcgcgcc
15421  actgcactcc agcctgggga acggagtgag acttcatctc aaaaataaat aaataaataa
15481  ataaataaaa taaataata aataaagtaa aaagatctct cattgaacca gatgatatat
15541  gaagtctctt ttaggaccaa tttcgagatt taaaaatt ggcagaatta cttttttttt
15601  ttgcagcgga gtccagcttt atcacccagg ctggagtgga atggcacaat ctcagctcac
15661  tgcaacctct gcctcctggg ttcaagcgat tctcctgcct ctgcctccca agtagctgtg
15721  attataggcg cccaccacca ggcccagctg attttgtat ttttcagtag agttgaggtt
15781  tcaccacgtt gtccaggctg gtctcaaact cctgacctta agtgatccgt ccaccttggc
15841  ctcccaaagt gctgggatta ggtgtgagcc actgggctgg cccagaatga tttttaaaaa
15901  gagatcagta aggccaggca gtggtggctc acgcctgtaa tcccagcact ttgggagact
15961  aaggtaggtg gatcacctga ggtcaggagt tgcagacaag cctggccaac atggtgaaac
16021  cctgtctcta ctaaaaatac aaaaattagc caggcatggt gacacatgcc tgtaatctca
16081  gctactcagg agggtgaggc agaattgctt gaacccggga gtcagtttct ttttctttt
16141  tttgagatgg agacccactt tgtcacccag gctggagtgc aatggtgcag tcttggctca
16201  ctgcaatctc tgtctccggg gttcaagtga tcctcctgcc tcagtctcct tagtagctga
16261  gactacaggt gtgcaccacc acacctggct aattttttgta tttttaggag agatggatgt
16321  caccatgttg gccaggctga tctttaaact cgtgacctga agtgatccac ccgccttggc
16381  ctcccaaaat gctgggatta caggtgtgag ccaccacgcc cagccctaaa gttgtatttt
16441  gatggaacga actgttttga gaaataaatt ttaacgcgtt gagtctgaac tgggctgccc
16501  tttcaaaatg tgaaggcccc ttaaagtagc acattggttg gttattcttt tatttattta
16561  gatatatctg atctagttgt ctttgggaca aactcatatt taatatcata gctgcatgta
16621  actgacagtg tagtctttgt cttcctgaag tgtttgtttg tttttgaga tggagtcttg
16681  ctctgtcgcc caggctgaag tgcagtggtg cgatcttggc tcactgcaac ctctgcctcc
16741  cgggttcaag tgattctcct tcctcagcct cccgagtagc taggactaca ggcatgtgcc
16801  accacaccca gctaattttt gtattttag tagagatggg gtttcaccat attggtcagg
16861  ttggtcttga actcctgacc tcgtgatctg cctgcttctg cctcccagag tgctgggatt
16921  acaggtgcga gccattgtgc ccagctagta agttttaag aaagattctc aaacctcttt
16981  taaatcgtct gcctcacttg aagaggtatg ccctacctgt ttagggctgt agacccaggt
```

```
17041 cattagaaga cagactaagt agtcctgggt gaacccatag ggcaccttca aggaggtaaa 17101 attggtgatt ttagtttcac cagtagtttt tccctgaata tttattcctt ttgtgcttta 17161 ttgatctatc tatatcaata aaaagtaatg gggcataaca aattatactt gtcattcttg 17221 ttcattaggg caaatgttgt aggttgagtc aagtgtccag ccaacaagtt attttatgtg 17281 tgtgtgtgtg tgtgtgtgtg tgtatacata tatacatttt tttttttttt tttcatcgag 17341 acagggtctt gcactgtcgc ccaggctgga gtgaagtggt gcaatctcgg ctcactgcaa 17401 cctctgcctc ccaggtttaa gtgatcttcc cacctcagcc tcccaagtag ctgggactac 17461 aggcgcacac caccaccctt ggctaatttt tgtattttt ttttggtaga gatggggttt 17521 caccacattg cccaggctgg tcttgaattc ctgacctcaa gtagtccgcc cacctaagcc 17581 tcccaaaatg ctgggattac aggcgtgagc caccacacct ggcatatata tattttaaga 17641 tagagatggg gtttgctatg ttgcccaggc tggtcttgaa ctgctgggat tacaggcgtg 17701 agcctctgca cccggccctt attgtttata aatacatttc tttctag*gtt caaaatcaaa*

17761 *ggaagcccag aagggaggtc atttttacag tgcaaagcct gaaatactga gagcaatgca*

17821 *acgtgcagat gaagccttaa ataaagacaa gattaagagg cttgaattgg cagtttgtga*

17881 *tgagccctca gagccagaag aggaagaaga gatggag*gtg ggacacggca agcattcagt 17941 tgttatttat gttagggtga tgggggaaga aaggggagg gtgtattaac aagatacctt 18001 gtttttatata tgtgtgtgta tatgtattat tttattatac atacatgcat acttctgtag 18061 ttccctggac tgtaggataa gttaggttac ttagaatctc aacagctagc atcgttttta 18121 cttaggtttt caagcctact ggcagggtaa gcaagaggta gtaccatttt ggtaagaagt 18181 agagagctag ggacagtaaa gatggagtaa tatatatatg agggtatagt caggccctag 18241 aaattaatta tccagtttta tgcttttat aaaaaaactg agatggggtc ttgctatgtt 18301 gcccaggctg gtctcaaact cctgagttca agggatctgc ccacctgggc ctcccaaagt 18361 gttgggatta caggcatgag ccacagcacc cagccccagc tttatgcttt taattctaaa 18421 acttttttg ttgtattttg cattcataag aatagatgtt aaataaacct tgaaatacaa 18481 ccttggctca aacgttaatg gtcatggata aagtgaatta aaacttgtta ggggccaggt 18541 gtggtggtta atgcctataa tcccagcact ttaggaagct gaggcagttg gatgtcctga 18601 ggacaggagt tcaagaccag cctggccaac acagtgaaac cctgtttcta taaaaaatac 18661 aaaaattagc tgggcgtggt ggcacacacc tgtagtccca accacttggg aggctgaggc 18721 atgagaattg cttgaacttg ggaggcagag ggacttggga ggcagagggt gtagtgagcc 18781 aagatcgcac cactgcattc cagccagggt gacagagcaa gagactgtc aacaacaaca 18841 aaaatgtta tagaagtgaa aaaaattgat taatttagaa caagcttgtc cagtctgtgg 18901 cccaggatgg cgtttaaatc agcccaacac aaatttgtaa actttcttaa aacattttgt 18961 gatttgttgt tgttgtttag ctcatcagct atcattagca ttagtgtatt ttatgtgtgg 19021 cctaagacaa ttcttccagt gtggcccagg gaagctgaaa gatcattatc ctctgatcta 19081 tcatattaat gagctgcatc ctaaaagaca ttcatctata actaagctca gtttcatgtt 19141 ttgttccttt ttcaatagat aagatagggga atgagcaagt taataaagtg ggtattttaa 19201 ttttaaggtt gaaactaagg atcataacat tatcagaggt ctagaactgg atggcagcta 19261 cagagatcat ttagcctaat actggtttaa caaataatcc gggagatccg tgatatgtga
```

```
19321  atgtgctagg cctgagatga gacagccaat tgtggaagag caaacactag aaccagtata
19381  agttgcttac tgctttctta tgctattaat gagcatatcg cctcctgata tttatgatat
19441  atggtcatgc caacagcttt gtcataaata gaactcccat ggcagcaatc acttaatctt
19501  gtagttagag gtggggtctc accatgttgc cgagctggcc ttgaacttct gggctcagcg
19561  attttctcca caggcacctg ctactgtgct cggtgcagca ctttgtgttt ttgaacataa
19621  cctcaagatg ttattgtctt catagtaaaa caaaagatga ggcttagaac tggatcactt
19681  tgcctgtctc ttcttacctc ctcccagttc aaaatgcttg catctcttaa tagctagcat
19741  tcccttggat tttgcacatg agctcaaact caagcctcag cacaatcttt tttatagttt
19801  tagtctttta gccagagtcg acttacccc cataccact ctgcttcctt cataatgctg
19861  ctttccctgg gcagagaatc cttgcccttc ttgtattatg tcactttgtg gggttggtgt
19921  ctgctacact tacagcaagt ccagagattt ttttccacc acgtttgcag gagaactatt
19981  ggcatggaaa atgacaattg ttttaatgtc aagtgaaact gaagttgatg ttcattgaga
20041  ggtttctaat ttctagaggt gggttctttt tttggcatat gaagttgcag catattaaga
20101  gaatttacag tagtacagat ggggttatcc catccacaac ttatgatggg gttacataaa
20161  ctaaaaacgt gtttaataca cctaccccac cgaatattgt agcttgggcg tagcctaacc
20221  tatctcagac gtgctcagaa cacttaaatg ttagcctaaa gttgggcaag atcatctaac
20281  acaaagccta ttttataata aggaattgcc tatctcatgt aattcatcga atactgtact
20341  aaaaatgaaa aacagtggct gcacgggtac cattataaag tcaaaaaatc ataagttgaa
20401  ctgtcttaca ttatggtttt ccaaatttg atttgttttt aaatactctt tccttgcctg
20461  gcag*gtaggc acaacttacg taacagataa gagtgaagaa gataatgaaa ttgagagtga*
20521  *agaggaagta cagcctaaga cacaaggatc taggcgaagt agccgccaaa taaaaaaacg*
20581  *aagggtcata tcagattctg agagtgacat tggtggctct gatgtggaat ttaagccaga*
20641  *cactaaggag gaaggaagca gtgatgaaat aagcagtgga gtgggggata gtgagagtga*
20701  *aggcctgaac agccctgtca aagttgctcg aaagcggaag agaatggtga ctggaaatgg*
20761  *ctctcttaaa aggaaaagct ctaggaagga aacgccctca gccaccaaac aagcaactag*
20821  *catttcatca gaaaccaaga atactttgag agctttctct gcccctcaaa attctgaatc*
20881  *ccaagcccac gttagtggag gtggtgatga cagtagtcgc cctactgttt ggtatcatga*
20941  *aactttagaa tggcttaagg aggaaaagag aagagatgag cacaggagga ggcctgatca*
21001  *ccccgatttt gatgcatcta cactctatgt gcctgaggat ttcctcaatt cttgtactcc*
21061  *tgggatgagg aagtggtggc agattaagtc tcagaacttt gatcttgtca tctgttacaa*
21121  *ggtggggaaa ttttatgagc tgtaccacat ggatgctctt attggagtca gtgaactggg*
21181  *gctggtattc atgaaaggca actgggccca ttctggcttt cctgaaattg catttggccg*
21241  *ttattcagat tccctggtgc agaagggcta taaagtagca cgagtggaac agactgagac*
```

```
21301  tccagaaatg atggaggcac gatgtagaaa gatggcacat atatccaagt atgatagagt 21361  ggtgaggagg gagatctgta ggatcattac caagggtaca cagacttaca gtgtgctgga 21421  aggtgatccc tctgagaact acagtaagta tcttcttagc ctcaaagaaa aagaggaaga 21481  ttcttctggc catactcgtg catatggtgt gtgctttgtt gatacttcac tgggaaagtt 21541  tttcataggt cagttttcag atgatcgcca ttgttcgaga tttaggactc tagtggcaca 21601  ctatccccca gtacaagttt tatttgaaaa aggaaatctc tcaaaggaaa ctaaaacaat 21661  tctaaagagt tcattgtcct gttctcttca ggaaggtctg atacccggct cccagttttg 21721  ggatgcatcc aaaactttga gaactctcct tgaggaagaa tattttaggg aaaagctaag 21781  tgatggcatt ggggtgatgt taccccaggt gcttaaaggt atgacttcag agtctgattc 21841  cattgggttg acaccaggag agaaaagtga attggccctc tctgctctag gtggttgtgt 21901  cttctacctc aaaaaatgcc ttattgatca ggagcttcta tcaatggcta attttgaaga 21961  atatattccc ttggattctg acacagtcag cactacaaga tctggtgcta tcttcaccaa 22021  agcctatcaa cgaatggtgc tagatgcagt gacattaaac aacttggaga ttttctgaa 22081  tggaacaaat ggttctactg aaggaaccct actagagagg ttgatactt gccatactcc 22141  ttttggtaag cggctcctaa agcaatggct ttgtgcccca ctctgtaacc attatgctat 22201  taatgatcgt ctagatgcca tagaagacct catggttgtg cctgacaaaa tctccgaagt 22261  tgtagagctt ctaaagaagc ttccagatct tgagaggcta ctcagtaaaa ttcataatgt 22321  tgggtctccc ctgaagagtc agaaccaccc agacagcagg gctataatgt atgaagaaac 22381  tacatacagc aagaagaaga ttattgattt tctttctgct ctggaaggat tcaaagtaat 22441  gtgtaaaatt atagggatca tggaagaagt tgctgatggt tttaagtcta aaatccttaa 22501  gcaggtcatc tctctgcaga caaaaaatcc tgaaggtcgt tttcctgatt tgactgtaga 22561  attgaaccga tgggatacag cctttgacca tgaaaaggct cgaaagactg gacttattac 22621  tcccaaagca ggctttgact ctgattatga ccaagctctt gctgacataa gagaaaatga 22681  acagagcctc ctggaatacc tagagaaaca gcgcaacaga ttggctgta ggaccatagt 22741  ctattggggg attggtagga accgttacca gctggaaatt cctgagaatt tcaccactcg 22801  caatttgcca gaagaatacg agttgaaatc taccaagaag ggctgtaaac gatactggac 22861  caaaactatt gaaagaagt tggctaatct cataaatgct gaagaacgga gggatgtatc 22921  attgaaggac tgcatgcggc gactgttcta taactttgat aaaaattaca aggactggca
```

```
22981 gtctgctgta gagtgtatcg cagtgttggg taagactttg aacaagcttg ttctcaggct 23041 ttgataagta gtgctgtttg ccagctgtat attatcccta aaaataagta ataaggtata 23101 tatggtacat attttgacat gcatatacat atttgcatcc tgactaggct gcccacagca 23161 atttaagtta cttgaaactc gcttttatct tagtagccct ttggcctttc ttcagttttt 23221 tttttttttt tttttttttt gagacatggt cttgctctgt tgcccaggct agaatatggt 23281 gacacaacca tggctactgc agcctcgacc tcccaggctt aagtgatctt tccacctcag 23341 cctcccaagt agctgagatt acagatatgc accaccatgc atggctaata tttaaatgtt 23401 tgtagagaga tggggtctca ctgtgttgcc aggactggtc ttgaactcct gggctcaagt 23461 gatcctcctg cctcggcttc ccaaagtgct gaggttacag gcatgaccca ttgcgcctgg 23521 ccctttcttc agtctttaat aatcgaacaa aaggttttg ttttagaca gtgtcttgct 23581 ctgttaccca ggacagacct ctcgtgtcag cctcttaggt agctaggatt tacaggtaag 23641 caccggcgtg ccctgcttta ttttttttggt ggggaaggg ggaagggagt tgaagcttcc 23701 ctatgttgcc caggctggtc ttgaactcct ggcctcaagt gatcctccag tctcccaaaa 23761 gtgctgggat tacaggcatg agccaccgct cccggcccaa aagattttta atgtgttat 23821 acttcatgag acaggcttta ttttagatcg aattttattt atcaataaaa agttgagctt 23881 tttattattt ggtgaatact gtttcaaggt gctttgttac actatctgtt gatccaacat 23941 ttaaaaattg ttttattaca acctttgcat ttcagtgaat ccatctgcat acaattttaa 24001 aagaatcatt cctttttttct gtagccaaat tgtcaaagat tctttcctac aattgatttt 24061 tcaaagccct gagttaggaa tttacaattt ggcaaccatc tcaacttcat aagcaatttt 24121 gttcttttaaa tgtcacggcc aacattacct ggaaccattg ctgttttata gtttaggttt 24181 atgttgtata tttttttttaa tttttttagag acggggtctt gctgttttca gactggagta 24241 caatgggatg actagctcac tgcagcctca aactgctggg ttcaagtgat tctccttcct 24301 cagcctcctg agtagctggg actacaggtg gtcaccatca cctggcta attttttgtat 24361 ttttggtaga gacagggttt ttcccgtgtt ggccaggctg ttcttgaatt cctgacctca 24421 aagcgatctg cccgccttga tctccgaaag agctgggatt acacgcatga gccactgcgc 24481 ccagccctgt tttttttttt tttttttttt taaataatgg tagttactt gaatttgtaa 24541 cacagtaaca caaaactatt ttgatctgaa cgcaagtatc taatggaaca gaataatata 24601 cttccttta gtgtgctgca tttggttact gggtaattta aaattcttcc tcagcacagg 24661 tgttcaaaaa ccagtcttca gagattgttt tcatatcagt gtgccaactt tggcacattc 24721 tgctaagtaa gaggcttaag tgtagcatgt ttctgctgtt ttgtgtttgt tttgttttgt 24781 ttttgagac agagtctctc tgtcgcccag gctggagtgc attggtgcga tcttggctca 24841 ttgcaacctc tgcctcccag gttcaagtga ttctcctgcc tcagcctcct gcgtagctgg 24901 gattacaggc atatgccacg tgtattaggc actgctaatt tctgtatttt tagtagagac 24961 gaggtttcac catgttggtc aggctggtcc tgaactgctg acctcgtgaa ctctgcccgc 25021 ctaggcctcc tgaagtgctg ggattacagg cgtgagccac cgtgcctggc ctctgctcta 25081 tcttttagct ttcccttggc acttctatgg tccagatgtt agagggtaag tattttgatg 25141 ggggagatcg ttggactgta attgaaagtt atgtcttata atgaaatgtg ttatataaag 25201 aagacctata aaacacttag gctgataaaa ccccccaaacg atgaagcctc acttttaccc 25261 tctcttttaa cagatgtttt actgtgcctg gctaactata gtcgaggggg tgatggtcct
```

```
25321  atgtgtcgcc cagtaattct gttgccggaa gataccccccc ccttcttaga gcttaaagga 25381  tcacgccatc cttgcattac gaagactttt tttggagatg attttattcc taatgacatt 25441  ctaataggct gtgaggaaga ggagcaggaa aatggcaaag cctattgtgt gcttgttact 25501  ggaccaaata tgggggggcaa gtctacgctt atgagacagg taactgattc ttaaagtttt 25561  gttatcagaa agtcatttgt gacattagga ataacatact taggtgatca ttttccaaac
25621  acagttacat aaaagtcagc cagtgactta ataggaagca aagggaaatt actccctgtg
25681  ttataaaatt gagaattata tttagctgaa acatcgatgc ttaatgttaa ggggaatata
25741  tgttaaaaag gggaaggagg tcagtcattc aggtcatgag gcccttttgac ttgaattcat
25801  ttcctcagaa ggtaggtata ttcatagtga acaaaaatac aaaggctgta tgaaaagatg
25861  aaaatgttac aggtttatcc ttaaattaga ctcatttgca gaaatgcaaa tgaggtaaga
25921  aagcaaatat agttcatgac ctctagcaac tgttgaaaac tgctctttag ggatgacatg
25981  ctggcccttt ttttttttgtt gttgccaagg ctgaagtgca gtggcaccat cacagctcac
26041  tgcagcctcg aactcccagg ttcaacccttt cctcctgcct cagcctcccc agtagctggg
26101  actacagatg tacaccatca tgcctagctc atttttaaaa aaattttttta tggcattgta
26161  tttatcttct ctttataacc aggggttgac cagccacaga acttgtaaag tttttttatat
26221  ttttaaaagg ttgtaagaaa tagtagtagt tggctggtcc ccgctgctct cctgcattat
26281  agtatacttc tgttcaccta gtttgctaga gagaggcagt atagtgtgta tagtgatttc
26341  caaactttt ctttaaatca gaatcacctg aaagaatgtg acaacgtgta aaaaaaaaa
26401  aaaaggtgca gagattccat cctgacatgg attcacttga ttggaattga ttctaggcat
26461  ctcagtagtt ttaaagagct cctaggtgat tctattctgg ccagcgttga gaatcactag
26521  ggtagtgggt tggtaagcag gctctgatgt tttaaaggcc aggtgaggcc ctatgcctct
26581  tgtctctctt agcctcaact ttctccatgt tagcaaatgg atttcagaac agaaccaacg
26641  tacatgtgat tgtgaaagtt gttttagagt gcctagctct tacgtaaggg ttcataagaa
26701  agacaaaagt ttatgaaact gttactacca gtcataaaag accttttcct ccctcattca 26761  caggctggct tattagctgt aatggcccag atgggttgtt acgtccctgc tgaagtgtgc 26821  aggctcacac caattgatag agtgtttact agacttggtg cctcagacag aataatgtca 26881  ggtgagtttt tgtttccca cttaagttct cattcagtca tttagatgtg ataaaagata 26941  tttgcttctt gtatatgagc cttttaaatc taatatttga ttttctggt gttactttaa
27001  aaacatcact ttttaagaac tgcatagtct ctctctcttt ttttttttt tgagatggag
27061  tttcccctctt gttgcccaag ctggagtgca atggcacgat cttggctcac tgcaacctct
27121  gcttccaggt tcaagtgatt ctcctgcctc agcctctcga gtagctggga ttacaggcgc
27181  atgccatcac gcccagctaa ttttttgtat ttttagtaga gcggggttt caccatgtta
27241  ggctggtctc ttaactcctg acctcaggtg atctgcttgc ctcggcctcc caaagtgctg
27301  ggattacagg cgtgagccac cgtgcccggc caataattgc atagtctctt aatgagattt
27361  aatcttttat accaatatgt gtagctcatg atagctatat aacctagaag atgaatttat
27421  gtaatatgat ttgcaaaatg agtattcatt tgtgattttt tttttttaa ggtgaaagta
```

```
27481 cattttttgt tgaattaagt gaaactgcca gcatactcat gcatgcaaca gcacattctc 27541 tggtgcttgt ggatgaatta ggtaagacat taaacttctc atttgaagac tatctatctt 27601 aaaaacattt gtacaaataa ctattttat agaagattat ctgaagtaca tttaaacaat 27661 atgaatgttt ttagagcacg cactcaccat tgtggcacag accgatagtt ggagataaaa 27721 ggtgatattg tgaaaggttt ttgattaccc attaattatt aggccttaca ctgtttagtt 27781 gtaataaaac atttgttata ctacggggat gagaacacta ataggaggac tcaggaagtt 27841 tatgaccttg agcgatactg tatttctttt aaaagaaacc tcactcccca tgggctgcta 27901 agcagactcg tgtagctaaa caaggcctat ttatagaatg cttttagacg tggatgtact 27961 aaccgatgtt gcttttctgt cctagcattt ttgttttaat tccttttttg ttttaattcc 28021 tttgagttac ttccttatgc atattttact ttaacaggaa gaggtactgc aacatttgat 28081 gggacggcaa tagcaaatgc agttgttaaa gaacttgctg agactataaa atgtcgtaca 28141 ttattttcaa ctcactacca ttcattagta gaagattatt ctcaaaatgt tgctgtgcgc 28201 ctaggacata tggtatgtgc aaattgtttt tttccacaaa ttcggttttt tgagagggca 28261 cttctcttgc tagcacatgt atcgctaata ttttctttc ttaaggcatg catggtagaa 28321 aatgaatgtg aagacccag ccaggagact attacgttcc tctataaatt cattaaggga 28381 gcttgtccta aaagctatgg ctttaatgca gcaaggcttg ctaatctccc agaggaagtt 28441 attcaaaagg gacatagaaa agcaagagaa tttgagaaga tgaatcagtc actacgatta 28501 tttcggtaac taactaacta taatggaatt ataactaact gaccttaagt ttcaaagaaa 28561 cagtaaaagg ggaagggatg atgcactatg aaaaaacaaa aaaactttt tttttttttt 28621 tttaatttta aggggaagttt gcctggctag tgaaaggtca actgtagatg ctgaagctgt 28681 ccataaattg ctgactttga ttaaggaatt atagactgac tacattggaa gctttgagtt 28741 gacttctgac aaaggtggta aattcagaca acattatgat ctaataaact ttattttta 28801 aaaatga
```

The genomic sequence for human MLH1 (found on human chromosome 3) has GenBank Accession No. NG_007109.2. Sequence information related to human MLH1 (isoform 1) is accessible in public databases by GenBank Accession numbers NP_000240.1 (protein) and NM_000249.3 (nucleic acid). Sequence information related to human MLH1 (isoform 2) is accessible in public databases by GenBank Accession numbers NP_001161089.1 (protein) and NM_001167617.1 (nucleic acid). Sequence information related to human MLH1 (isoform 3) is accessible in public databases by GenBank Accession numbers NP_001161090.1 (protein) and NM_001167618.1 (nucleic acid). Sequence information related to human MLH1 (isoform 4) is accessible in public databases by GenBank Accession numbers NP_001245200.1 (protein) and NM_001258271.1 (nucleic acid). The genomic sequence for human MLH1 (GenBank Accession No. NG_007109.2; 79,540 bp in length), is found at nucleotide no. 5,001 and terminates at nucleotide no. 62,497, wherein exon 1 is located between nucleotides 5,001 and 5,314; exon 2 is located between nucleotides 8,270 and 8,360; exon 3 is located between nucleotides 12,606 and 12,704; exon 4 is located between nucleotides 16,052 and 16,125; exon 5 is located between nucleotides 18,642 and 18,714; exon 6 is located between nucleotides 20,465 and 20,556; exon 7 is located between nucleotides 23,471 and 23,513; exon 8 is located between nucleotides 23,662 and 23,750; exon 9 is located between nucleotides 26,083 and 26,195; exon 10 is located between nucleotides 29,157 and 29,250; exon 11 is located between nucleotides 31,961 and 32,114; exon 12 is located between nucleotides 37,288 and 37,658; exon 13 is located between nucleotides 40,435 and 40,583; exon 14 is located between nucleotides 51,837 and 51,945; exon 15 is located between nucleotides 53,919 and 53,982; exon 16 is located between nucleotides 59,170 and 59,334; exon 17 is located between nucleotides 60,168 and 60,260; exon 18 is located between nucleotides 60,555 and 60,668; and exon 19 is located between nucleotides 62,137 and 62,497. It is understood that intron sequence precedes and follows the denoted nucleotide regions comprising the exon sequences listed herein. Oligonucleotide compounds (e.g., exon skipping or intron retaining SSOs) can be directed to the nucleic acid sequence corresponding to the region of interest for each of the exons 1-19 described herein, and intron-exon junctions, or exon-intron junctions listed with GenBank Accession No. NG_007109.2.

The genomic sequence for human PMS1 (found on human chromosome 2) has GenBank Accession No. NG_008648.1. Sequence information related to human PMS1 (isoform a) is accessible in public databases by GenBank Accession numbers NP_000525.1 (protein) and NM_000534.4 (nucleic acid). Sequence information related to human PMS1 (isoform b) is accessible in public databases by GenBank Accession numbers NP_001121615.1 (protein) and NM_001128143.1 (nucleic acid). Sequence information related to human PMS1 (isoform c) is accessible in public databases by GenBank Accession numbers NP_001121616.1 (protein) and NM_001128144.1 (nucleic acid). Sequence information related to human PMS1 (isoform d) is accessible in public databases by GenBank Accession numbers NP_001276337.1 (protein) and NM_001289408.1 (nucleic acid). The genomic sequence for human PMS1 (GenBank Accession No. NG_008648.1; 100,545 bp in length), is found at nucleotide no. 5,001 and terminates at nucleotide no. 98,545, wherein exon 1 is located between nucleotides 5,001 and 5,509; exon 2 is located between nucleotides 12,706 and 12,857; exon 3 is located between nucleotides 16,685 and 16,867; exon 4 is located between nucleotides 26,568 and 26,670; exon 5 is located between nucleotides 38,933 and 39,096; exon 6 is located between nucleotides 64,880 and 64,996; exon 7 is located between nucleotides 73,571 and 73,693; exon 8 is located between nucleotides 74,855 and 74,998; exon 9 is located between nucleotides 75,155 and 76,044; exon 10 is located between nucleotides 84,659 and 85,144; exon 11 is located between nucleotides 88,715 and 88,845; exon 12 is located between nucleotides 94,412 and 94,572; and exon 13 is located between nucleotides 98,188 and 98,545. It is understood that intron sequence precedes and follows the denoted nucleotide regions comprising the exon sequences listed herein. Oligonucleotide compounds (e.g., exon skipping or intron retaining SSOs) can be directed to the nucleic acid sequence corresponding to the region of interest for each of the exons 1-13 described herein, and intron-exon junctions, or exon-intron junctions listed with GenBank Accession No. NG_008648.1.

The genomic sequence for human PMS2 (found on human chromosome 7) has GenBank Accession No. NG_008466.1. Sequence information related to human PMS2 (isoform a) is accessible in public databases by GenBank Accession numbers NP_000526.1 (protein) and NM_000535.5 (nucleic acid). The genomic sequence for human PMS2 (GenBank Accession No. NG_008466.1; 42,868 bp in length), is found at nucleotide no. 5,001 and terminates at nucleotide no. 40,868, wherein exon 1 is located between nucleotides 5,001 and 5,110; exon 2 is located between nucleotides 8,076 and 8,215; exon 3 is located between nucleotides 10,049 and 10,135; exon 4 is located between nucleotides 10,315 and 10,417; exon 5 is located between nucleotides 11,471 and 11,654; exon 6 is located between nucleotides 14,832 and 14,999; exon 7 is located between nucleotides 16,684 and 16,781; exon 8 is located between nucleotides 18,474 and 18,573; exon 9 is located between nucleotides 22,050 and 22,134; exon 10 is located between nucleotides 24,152 and 24,307; exon 11 is located between nucleotides 26,487 and 27,348; exon 12 is located between nucleotides 31,116 and 31,283; exon 13 is located between nucleotides 35,411 and 35,511; exon 14 is located between nucleotides 36,350 and 36,519; and exon 15 is located between nucleotides 40,565 and 40,868. It is understood that intron sequence precedes and follows the denoted nucleotide regions comprising the exon sequences listed herein. Oligonucleotide compounds (e.g., exon skipping or intron retaining SSOs) can be directed to the nucleic acid sequence corresponding to the region of interest for each of the exons 1-15 described herein, and intron-exon junctions, or exon-intron junctions listed with GenBank Accession No. NG_008466.1.

Sequence information related to human MLH3 (isoform 1) is accessible in public databases by GenBank Accession numbers NP_001035197.1 (protein) and NM_001040108.1 (nucleic acid). Sequence information related to human MLH3 (isoform 2) is accessible in public databases by GenBank Accession numbers NP_055196.2 (protein) and NM_014381.2 (nucleic acid). The genomic sequence for human MLH3 (GenBank Accession No. NG_008649.1; 44,769 bp in length), is found at nucleotide no. 5,001 and terminates at nucleotide no. 42,769, wherein exon 1 is located between nucleotides 5,001 and 5,153; exon 2 is located between nucleotides 6,815 and 10,157; exon 3 is located between nucleotides 14,056 and 14,154; exon 4 is located between nucleotides 14,833 and 14,918; exon 5 is located between nucleotides 16,518 and 16,622; exon 6 is located between nucleotides 18,121 and 18,193; exon 7 is located between nucleotides 23,043 and 23,114; exon 8 is located between nucleotides 24,354 and 24,465; exon 9 is located between nucleotides 25,831 and 25,990; exon 10 is located between nucleotides 33,515 and 33,538; exon 11 is located between nucleotides 33,641 and 33,719; exon 12 is located between nucleotides 37,553 and 37,704; and exon 13 is located between nucleotides 39,332 and 42,769. It is understood that intron sequence precedes and follows the denoted nucleotide regions comprising the exon sequences listed herein. Oligonucleotide compounds (e.g., exon skipping or intron retaining SSOs) can be directed to the nucleic acid sequence corresponding to the region of interest for each of the exons 1-13 described herein, and intron-exon junctions, or exon-intron junctions listed with GenBank Accession No. NG_008649.1 and described in SEQ ID NO: 1. The human MLH3 gene sequence (GenBank Accession No. NG_008649.1; found on chromosome 14) is depicted in SEQ ID NO: 1 below, where the bolded italicized nucleotide bases correspond to EXON regions.

SEQ ID NO: 1

```
  1 gatcatttga gcctgggagg ttaaggctgc aataagctgt gactgtgcca ccatccttca 61 gaaaaaaaaa agaaaaagga aagaggtat tgacaattca cattcatgtt tcaaagattc
```

-continued

```
 121 cttccaggtt agaatttgaa ttttaagtac cacagtccca ggaatgagac acttattttt
 181 catttttatt ttttagcttt agttttagta tgaggataat gctggcttaa taaaatgtgt
 241 tgggaagtgt ttcctcttct tttttttaac ccttaattct tggtttggat cttcttctat
 301 ttttttggaag agtttgtgaa gggttggtaa aggattttt tttaaacatt tggtagaatt
 361 tacccatgaa gccatctggt cctgggcttt ttatctgtgg gaagttttg attacaaatt
 421 ccatctcttg gtataggtct attcagactt tctatttctt cttgattcag ttttggttgt
 481 ttgtctttct aggtattagg tttgttttca tccaaaaaaa tttaatctaa ttttttggca
 541 tataattgtt catagaattc ccttttatcc ttttatctt tgtaaggttg gtgtaatgt
 601 ctccttttat ttctgatttt agtaatttga ggctttcatc cgttttcctt tatcagtcta
 661 gctaaaggtt gtcaattttg ttgatcctgt caaagaagca acttttgttt tattgatttt
 721 ctctattctt ctgctttcca ttaatttctg ctctaatctt tatttccttc tttctgctca
 781 ttttgaattc agtttgctct tcttttttcta gtatcctaag gtggaaatct tgattattga
 841 tttgaagaga gtttcttttt agattgcaac tagaggtggt gattacagtc cttgaaatgt
 901 tgtcagatga ttgtttaagc aaaaatatgg ttatgaggta gaattcactt tttggaattt
 961 tcttagggga gaaaaaccct gttggtgcaa tagatattca aaactgaaca tgagtcaata
1021 acattatgtc atcattaaaa aaataagaac agagttgagc acacaaatga aaccagtagg
1081 aaacgcccat tctcaacact ggtcaaattt tggagtgttc tgttcaactc tcaagagttc
1141 agataaggcc aggtgcagtg gctcatgcct gtaatcccag cactttggga ggccgaggca
1201 ggcggatcat gaggtcagga gatcgagacc atcctggcta acacagtgaa accccatctc
1261 tactaaaaat acaaaaaaat tagccgggag tggttgcggg cgcctgtggt cccagctact
1321 ggggaggctg aggcaggaga atggcataaa cctgggaggc ggagcttgca gtgagctgag
1381 atcacgccac tgcactccag tctgggcgac agagcgagac tccgtctcaa aaaaaaaaa
1441 aaaaaaaaaa aaagagttca gataaatcac attgcaaatt tttaaagatt tatttgactg
1501 tgacaacctc ctgtttaaaa ctgcacattc ttacagctat ttaccatata agataactct
1561 taagaactgg agatagtcag ctcccctggg ttaatttgaa gcagaagagg gcagttgtta
1621 tactgccctg tcagttggat gcggagtctt actcaaaatt cattctcagc attcttcttt
1681 tatggtatct tctttggcac ttagcagcgc atcaggtagg catcttctat ttttcttcat
1741 tccttaattt cctttgtatc cctcaaatgg ttatttattt ggctggagtc tgttttgttc
1801 attaagcaaa catgtctttg ctttgaacat gtctttgatt tgatggatac ttaaattcct
1861 catcaaacat tttgttgcta tgcataacgt tttctttggc caactccagc aatttcccac
1921 attttgacat gcaatcatgt taactcccat tttcttttgt aatccaacat cttctattta
1981 gataattact ttaacaatca atgacttaat attctaatca taaatttata caaaaataaa
2041 attacctcca aaacattgct acctttccta aacattcagt cttgccacag tttaataaaa
2101 ggaaagaaca ttaaaaagga taagacactg taatgattag atgctttta taagcctaaa
2161 ggcattgtga ttatttagac agaagagaag aaagtgaagt gaaacctga tagttatgta
2221 gtctcatggt ttgctgttga gaggctgaac accagctgct tccttttct aggaagataa
2281 taaagtgggc tttggctaca acataaagat gttgggttag acagtttcac tacagtaaga
2341 acaacgggat gagttgccca ggaaattgtg aaatactttc taatgatctt taaagatata
2401 atgaacacta attcatctgg atttgtttac gtgtggtcct ggttaaaggc aaagggaagg
2461 atcagataac ttcatgtttt ttccatttaa catacccaat agattcttga ttaggggaag
```

-continued

```
2521 ggaaaatgag caagatacag tccagtattc taaaaacaat cagccttagg ggatcatttc 2581 aaaagcatct gttttggact taagtctttg atacttaacc aaattgacta cacagtgaaa 2641 aattctagtg cctgggtttt atagggtaga agaaagacat gcagtcaagt ggccaatact 2701 tcatgtgaag ataagcaatg agatccttct tgctgtcttt cttttgactg ttctgggcaa 2761 tatcaaatta gtttcagtgg cttgattcta ggccaagatt ctggcaacag attgtagtct 2821 taccttgttt tcttcaatct cactggatct ctctctcttt ttaccccct taggctgagg 2881 gtaaaaagct gggattggta ggctgggtcc agaacactga ccggggcaca gtgcaaggac 2941 aattgcaagg tcccatctcc aaggtgcgtc atatgcagga atggcttgaa acaagaggaa 3001 gtcctaaatc acacatcgac aaagcaaact tcaacaatga aaagtcatc ttgaagttgg 3061 attactcaga cttccaaatt gtaaaataat ggcctgaatt taagttttct aagataaact 3121 cagtggtttg gttttttatta ttaatagaga tagaactatt gtgtgttaat attagcatta 3181 gtcaataagt tattttaatg tcagattttt gaatgttatt atatattacc tgtatgatgg 3241 aaggattacc actgtacaca aatctaatca ataaaaacgt tagaaccttc tgcttagagt 3301 acttttaaaa aatcttcagt gaacttcctt ttgggcgaaa tgagaggtct ttattcagta 3361 aacatttgta ggaagaggat tttgaggtaa tttaaagagg tctgaaagaa aaaaagtctg 3421 agtcatttct ttaaatggtt tctatgaaat gttcttcaag aaattccatg cctaataaga 3481 acaaatacca caagttcaat ttgttagctc tgttcacctt atgtttggat gaattacttc 3541 tgctgttgtt tcttttctct gggtaaggaa ttcacataaa gttatgttat gggctgaact 3601 gtgtcccacc aaattcatat gttaaagtct cagtcccag tacctcagaa agtgactgta 3661 tttggacata gggcctttaa agaggtgatt aagattaaat gaggctgtga gggtgggccc 3721 taatccaatc tgactggtgt tcttataaga gaacatattg gctatagaca cgtgtgcaaa 3781 aatcaaagac cctgtgaaaa tggccatcta caagccaagg agagaggcct caggagaaat 3841 cgttgctgcc aacaccttga tctcagactt ccagtctcta gaactgagag gaaatagact 3901 tctgctgctt aagctactca gtctgaggta ttttgttatg gcagccctag gtatagtaat 3961 aatcataaac agttatcagg atttttgctta atcagcccta gaagactggt tggttgggtt 4021 tggttagtca ctaaactagc atatatcaaa tgcttaccag gtctgacaaa ttcgttataa 4081 attccacttt aaattctcaa tgaaaatgag atagaaagca aaaactaagg actggttaac 4141 aattccaaaa cactttattc tcacagcatt ctcagagttc tgctctcctt tagttatttt 4201 tataactaaa agctgtggtg gcactgggga gattcaagtc agtgaagaga gtcttggtgt 4261 tgtcatctgt aaattaagag ttgagcaaag gccgggtgcg gtggctcacg cctgtaatcc 4321 caacactttg ggaggccgag gcgggcagat cacctgaggt ccggagttcg agaccagcct 4381 gaccaacatg gagaaacccc cgtctctact aaaaatacaa aattagccga gtgtggtggc 4441 gcatgcctgt aatcctagct actcgggagg ctgaggcagg agaatcactt gaaccctgga 4501 ggcggaggtt gcagtaagct gagatcgcac cactgaattc cagcctgggc aacaagagct 4561 aaactccgtc tcaaaaaaaa aaaaaaaaa aaaagagtt gagttagaca gtttctcagc 4621 cttttccagc tccaaatgcc ataattctaa gatggcaggc tctggaatta ttcattcatt 4681 cggtgcctac cataggccag gcactgttct tggtaactgg gatacagcag taaacaaaat 4741 atataaactc cttaccttca catagcttac attctaggga gagaagacaa taagtaaaca 4801 cataaaatat atattgaatt aaacggtagt taagagcaaa ggtgaaaatg agaaaaaaaa 4861 ggaaagggaa aacacgggaa aaaaaataa aaacaaaagt aaaagctacg acatagtctt 4921 taacaccatg ccaaaaggga ataaggattg agactgtagg taccggttca ctgaaccctg
```

-continued

```
4981 ggatgcggat ccttggctgg aacaactggt gcgcatgcgc actggtgtct cgcggcctgg 5041 cgcgccccct ccgaagcgca tgctcgtggg cacgcacgag cctcaagatc caaggtgcgc 5101 gcgtcggcgt ccgaggcggt tggtgtcgga gaatttgtta agcgggactc caggtgactc 5161 tgggggaagc acgcgacgaa aagatgatgc cggggtctct tctaacacca gaagggccct 5221 gatgatggct gcgcgcagct ttcggagccg gatgcgcgag ggccccggag gccggcggc 5281 ctggcggccg gcgggccca gtttggggac aaggacgggg ctggccaggg aggggctggg 5341 cctggcggga aggcagcgct gccccggact cggcccgcgc ggccctccca ggccccgtg 5401 ccctggatcc aggcccgtgc gtcccgtcag tcccaggcgc tgggaggcgt catcaggaaa 5461 tcattgggtt tacattaatc ggaatacttg ttaaacgttt acccgtcagt tgctgccggc 5521 tgcttagtgc attagcttag aaagcagcag aaattctgca gttaagagcc ctgatttgtc 5581 ccgagtttgg aaaaccggcc ccaccgcctg caggggccca cccacgtggc tctcactgat 5641 ggagaagaag gggagacctt taatggcact ggaatcttag ggtttggttt ttttttgtttt 5701 gttttttgtt tttgtgtttt cacttgcagg aaaacttaaa atcaagttca ggcagcccca 5761 tgccatcatt attattacca aggtagttta tgcccatctg taaagaccaa aagaatatta 5821 ataatgacct tctggccggg cgcggtggtt cacacctgta atcccagcac tttgggaggc 5881 caaggcggga ggatcacttg agttcaggag ttcgagacca ggctggttaa catggtgaaa 5941 ccccatctct acataagaga caaaaattag ccaggcatgg tggcgagcgc ctgtaatccc 6001 agctactcgg gaggctaagg ctggaggatt gcttgagccc gggaggtgca ggctgcagtg 6061 agccgagatt gtgtcattgc actccagcct gggtgacaga gtgagactgt ttcaaaaaag 6121 aataataacg actttctaaa aacatcagag taatacatga acaggattta acaatcaaat 6181 ggcaaagaaa ggtttatatg aaaaggaatt ttcctgcttt atcttttccc attcccagcc 6241 tctttccctg aggtgactat acttaaccat aataataata acctcttaat gcccccaatc 6301 tctctttgat acaatttgat tcttaaaatt tcttcctatt gcttcacctt attacaatgt 6361 cttagcaatt cattataagt attttctaa aagtcatggt tattgtgtaa tgtataaatg 6421 ttatgaaact agcttggaca tttttgtcat gaataatttc tagctaatgt tccttagctg 6481 tatttaattt aggcatctgt ttttggtgaa gtggttagaa tttcgaatac tgtgtttact 6541 ggtcaacttc aagtgtaatt atgatttcac tttaggacat gtgggattta gaaaggagca 6601 ttgaaaatta tgaaattatg aattttttt ggatgttaat ccattgcacc aagcatgagc 6661 tgtgcctaga gatcagcggt ataactttgt tttgctttgt ttcacaattt ggtttaataa 6721 gagtgatttc atttacctca agtgctattt cttcataatg ctgtgtaatg ctaaagcttt 6781 gattatgtgc gtgtgtggtt tttttctcca ataggcaatt atttccagtc agagaaggaa 6841 accagtgcct ggcattctca ccatctttct acctaccatg atcaagtgct tgtcagttga 6901 agtacaagcc aaattgcgtt ctggtttggc cataagctcc ttgggccaat gtgttgagga 6961 acttgccctc aacagtattg atgctgaagc aaaatgtgtg gctgtcaggg tgaatatgga 7021 aaccttccaa gttcaagtga tagacaatgg atttgggatg gggagtgatg atgtagagaa 7081 agtgggaaat cgttatttca ccagtaaatg ccactcggta caggacttgg agaatccaag 7141 gttttatggt ttccgaggag aggccttggc aaatattgct gacatggcca gtgctgtgga 7201 aatttcgtcc aagaaaaaca ggacaatgaa aacttttgtg aaactgtttc agagtggaaa
```

-continued

```
7261  agccctgaaa gcttgtgaag ctgatgtgac tagagcaagc gctgggacta ctgtaacagt
7321  gtataaccta ttttaccagc ttcctgtaag gaggaaatgc atggaccota gactggagtt
7381  tgagaaggtt aggcagagaa tagaagctct ctcactcatg caccottcca tttctttctc
7441  tttgagaaat gatgtttctg gttccatggt tcttcagctc cctaaaacca aagacgtatg
7501  ttcccgattt tgtcaaattt atggattggg aaagtcccaa aagctaagag aaataagttt
7561  taaatataaa gagtttgagc ttagtggcta tatcagctct gaagcacatt acaacaagaa
7621  tatgcagttt ttgtttgtga acaaaagact agttttaagg acaaagctac ataaactcat
7681  tgactttta ttaaggaaag aaagtattat atgcaagcca agaatggtc ccaccagtag
7741  gcaaatgaat tcaagtcttc ggcaccggtc taccccagaa ctctatggca tatatgtaat
7801  taatgtgcag tgccaattct gtgagtatga tgtgtgcatg gagccagcca aaactctgat
7861  tgaatttcag aactgggaca ctctcttgtt ttgcattcag gaaggagtga aaatgttttt
7921  aaagcaagaa aaattatttg tggaattatc aggtgaggat attaaggaat ttagtgaaga
7981  taatggtttt agtttatttg atgctactct tcagaagcgt gtgacttccg atgagaggag
8041  caatttccag gaagcatgta ataatatttt agattcctat gagatgttta atttgcagtc
8101  aaaagctgtg aaagaaaaa ctactgcaga aacgtaaac acacagagtt ctagggattc
8161  agaagctacc agaaaaaata caaatgatgc attttttgtac atttatgaat caggtggtcc
8221  aggccatagc aaaatgacag agccatcttt acaaaacaaa gacagctctt gctcagaatc
8281  aaagatgtta gaacaagaga caattgtagc atcagaagct ggagaaaatg agaaacataa
8341  aaaatctttc ctggaacata gctctttaga aaatccgtgt ggaaccagtt tagaaatgtt
8401  tttaagccct tttcagacac catgtcactt tgaggagagt gggcaggatc tagaaatatg
8461  gaaagaaagt actactgtta atggcatggc tgccaacatc ttgaaaaata atagaattca
8521  gaatcaacca aagagattta agatgctac tgaagtggga tgccagcctc tgccttttgc
8581  aacaacatta tggggagtac atagtgctca gacagagaaa gagaaaaaaa aagaatctag
8641  caattgtgga agaagaaatg tttttagtta tgggcgagtt aaattatgtt ccactggctt
8701  tataactcat gtagtacaaa atgaaaaaac taaatcaact gaaacagaac attcattaa
8761  aaattatgtt agacctggtc ccacacgtgc ccaagaaaca tttggaaata gaacacgtca
8821  ttcagttgaa actccagaca tcaaagattt agccagcact ttaagtaaag aatctggtca
8881  attgcccaac aaaaaaaat gcagaacgaa tataagttat gggctagaga atgaacctac
8941  agcaacttat acaatgtttt ctgcttttca ggaaggtagc aaaaaatcac aaacagattg
9001  catattatct gatacatccc cctctttccc ctggtataga cacgtttcca atgatagtag
9061  gaaaacagat aaattaattg gtttctccaa accaatcgtc cgtaagaagc taagcttgag
9121  ttcacagcta ggatctttag agaagtttaa gaggcaatat gggaaggttg aaaatcctct
9181  ggatacagaa gtagaggaaa gtaatggagt cactaccaat ctcagtcttc aagttgaacc
9241  tgacattctg ctgaaggaca agaaccgctt agagaactct gatgtttgta aaatcactac
9301  tatggagcat agtgattcag atagtagttg tcaaccagca agccacatcc ttaactcaga
```

-continued

```
 9361 gaagtttcca ttctccaagg atgaagattg tttagaacaa cagatgccta gtttgagaga 9421 aagtcctatg accctgaagg agttatctct ctttaataga aaacctttgg accttgagaa 9481 gtcatctgaa tcactagcct ctaaattatc cagactgaag ggttccgaaa gagaaactca 9541 aacaatgggg atgatgagtc gttttaatga acttccaaat tcagattcca gtaggaaaga 9601 cagcaagttg tgcagtgtgt taacacaaga tttttgtatg ttatttaaca acaagcatga 9661 aaaaacagag aatggtgtca tcccaacatc agattctgcc acacaggata attcctttaa 9721 taaaaatagt aaaacacatt ctaacagcaa tacaacagag aactgtgtga tatcagaaac 9781 tcctttggta ttgccctata ataattctaa agttaccggt aaagattcag atgttcttat 9841 cagagcctca gaacaacaga taggaagtct tgactctccc agtggaatgt taatgaatcc 9901 ggtagaagat gccacaggtg accaaaatgg aatttgtttt cagagtgagg aatctaaagc 9961 aagagcttgt tctgaaactg aagagtcaaa cacgtgttgt tcagattggc agcggcattt 10021 cgatgtagcc ctgggaagaa tggtttatgt caacaaaatg actggactca gcacattcat 10081 tgccccaact gaggacattc aggctgcttg tactaaagac ctgacaactg tggctgtgga 10141 tgttgtactt gagaatggta agtacgtagt attcatgtgc atgagatgct tttgaagatg 10201 ggaatgctgg acaaggagta agatcctcat tatccaaaga gattatctca acagatagaa 10261 catttgaag accacttata aaacatatgt tgtattttca tgctatatga agatttgcta 10321 cgtccaacac tactttttt ttttttttt tttgagacgg agtcttgctc tgtcacccag 10381 gctggagtgc agtggtgcga tctcagctca ctgcaacctc tgccccctg gttcaagcga 10441 ttctcctgcc tcagcctcca gtgtagcttg gattacaaga gcatgccacc atgcccagct 10501 aaatttttt attttcagta gagacaggat ttcactatgt tggccaggct ggtctcaaac 10561 tcctagcctc aagtgatcca cctgcctcgg cctcccagag tgttgggatt ataggtgtga 10621 gcccgcacgc agcctctagg tccaacacta tttaaatgga aagtacagt gaaaggatgt 10681 cagtgtgtgt atatgtgtct atgggtgtgt gtatgtgtaa gaaggggggt gatgggtata 10741 tacctagagc aacaacaaaa ggggtgagac tgtccaattt taataaaaat gatactatta 10801 atagttggga agatccacag tactttccta ccttgttttc ccttcctgtt aaatgcccag 10861 ctttcctaga aatgtgtctt taaaggcacc tgcagtgtca gcatggtatt ttactggaag 10921 tttctctgcg tggcttccag gttaagggcc agaatgattc tgtaatcatc ctaggtttcc 10981 cagtaaactc tatggcttag tacagtacta catttatgag cttttttctt ctagaaagta 11041 ggacttgtcc atgaattttc aaaatatagg tcaagtatat actttcatga ctatacttt 11101 caaatgtact ttattataat gcatatggta aaatctcctt gatgtgttta tggtacaagt 11161 agctgttatt caggaagaca ataatatggc atttatttat ttgagacaga gtttcactct 11221 tgttgcccag gctggagtgt agtggcgtga tctcggctca ctataacctc cgcctcccag 11281 gttcaaggga tcctcctgcc tcagcctccc aagtagctgg gattacaggc accgctacc 11341 acaccggct aattttttgt gttttttgtag agacaggg tt taccgtgtt ggccaggctt 11401 gtctcgatct cctgacctca ggtgatccac ctgcctcggc ctcccaaagt ggtgggatta 11461 taggcgtgag ccactgcacc caaccaatat agcttttaga tcgtaccaca gggctacatt 11521 agagcctgca ctaggactct gggttctcgg tccacattta aagtgatatt gctttggcag 11581 tgtgttgaga gccagatgtt gggaggtgat aaagctgatt tccatctggc tataatcttg 11641 gctttgcact aggaggataa acattacatc tgtatccgta tttaaaattt tgaatgctgc
```

-continued

```
11701 agaagaatgg aacatgtata aatgtagtta taagtcaatt tctaatttct cctgacgatg
11761 aatatctcta gcagaaagct gtggtttctt taaggttaaa tgaaaccttt acttttcagt
11821 gtttttctgt ttttccttgt gaaaaaaaaa tcactgtagt aacttcagta gtatttcata
11881 gtattttgta gtattcatta ggagaaaact catttctttc actgttgttc ctgagactat
11941 caagttgctc ttaaagccac tttatgtgct tttcaatcta tgtggtttta tgtcctgact
12001 tacactgaag gcttttcaga ggtaaatcta cagcactgac acctcatctt cctgaaatgc
12061 aactgcttct gatatggtgc caaaaaataa ctggattaca ttatactgtg agatggctgt
12121 tgctaaaaga aaggggaaaa tcttagctgc catattcaac gtaaatattt cttccttttg
12181 aatatagacg tttaaaacac tttaacctac ttaacattct ggattagcat acttttttat
12241 gaacttttga gggtcatgtt aactgatagt ttcctaatga aaaatatttt tggtatagaa
12301 agaagttcca tgaacagatg gctcctcagt accctgctac ctttctggaa atggctgata
12361 tacatcatga catcaggaca ttgtcaaact ttacataaaa gtgttacatg aaataaattg
12421 ttaaaagaca attttttttt tttgagacgg agtttcgctc ttgttgccca ggctaaagtg
12481 aaatggtgcg atctcggctc actgcaacct ccgccttctg agttcaagcg attctcctgc
12541 ctcagcctcc tgagtagctg gaattacagg catgcgccac catgcctggc taattttgta
12601 tttttagtag agacgggatt tctccatgtt ggtcaggctg gtctcaaact cccaacctca
12661 ggtgatctgc ccgcctcggc ctcccaaagt gctgggatta caggcgtgag ccaccagcct
12721 aaaagataca ttttaatgta cagaaggagg atctataaag gtgattttga ggagtagtgt
12781 caagtcccca agccttggta attttttctt taaaatatat tttatgcagt tcttttctatt
12841 gtagttataa accttatttc acttcattat cttaatttta tcattcttaa cctctccagg
12901 tttagtccaa cagatttatc tctcatgttt tcctcctgtt ctaaagctgt caaattcagc
12961 attgtttcta aaactcaaat ctgattatcc ttcatggaga agaacagcat ttgggccaga
13021 tcttactaga ctctggagtt tgaattgaga acctttcatt tgtctacctg ttcactttt
13081 catgcagcat ttgttgatca tccacactgt gctaggtgct gtcacgttgc aggttaactg
13141 actttgcttt taggagttca cagtactatt agggaagata gctatctaaa tataattgta
13201 ttataatgag acaaatgtta ggatagagac atacattgga gataagagac ataagttgga
13261 gatttgtgaa ggttgcacca agttatggct gacaagtact gctgtatgtc taacacaggg
13321 cttctctggg taatttttg ttgtaaggtt tgtcctatgc attgtagaat atttagcagc
13381 atccgtggcc tttatctgct agatgctagt agaacgtaga acccttact caagttgtga
13441 caatgaaaag tgtctcaagc cgggcacagt ggctcacgcc tgtaatccca cactttggg
13501 aggccgaggc gggtggatca caaggtcaag agtttgagac cagcccggcc aatatggtga
13561 aaccccatgt ctactaaaaa tacaaaaaaa ttagccgggt gtggtgacgc atgcctgtaa
13621 tcccagctac tcgggaggct gaggcaggag aattgcttga acccgggagg cggaagttgc
13681 agtaagccga gatcacgcca ctgtactcca gcccgggcga cagagcgaga cgccgtctca
13741 aaaaaaaaaa aagggtctc aagacattgc caatgtcccc tcgtgcaaaa ttgcccccca
13801 gtgagaatca cagtgaccta ttctaggtct tcattctgtc tggtatgaat agataatgga
13861 actaagcatt aatatagagt cctatatgga cagcataatt tcattaaagg atttctgatt
13921 ctcaatctag tgtttagtag tctgctttat gtcttgactc agtttgtgca gaaagaggtt
13981 ttatgtgatt aaattttaa agagtttact tgtattttaa gttcacattt ctaggttttt
```

```
14041  cttcttata tttagggtct cagtacaggt gtcaaccttt tagaagcgac cttgttcttc 14101  ctttccttcc gagagctcga gcagagagga ctgtgatgag acaggataac agaggtaagg 14161  gtggcagaga gtgctggggc acacagtaca catcgtacca cctaactcaa aaaacaaagc 14221  aggcttgcat taagcttgat cagtgccagc tgtgctgtac tggaatcagg aattccccac 14281  ggccctgttt aacagcggaa ctaattaatt cagcgcatgc atttaggtca gaaattactt 14341  ttccagactt gaggtcaata tttgctgatt atgcatagtc tgtggtgtct tgtgattagg 14401  ggacatgttt cttatttttta aaaaggctgg acttgcactc caagttgctg tagttttatg 14461  taagcaaaac tcttcaaaaa aagctacaga catcaatttt gtgtgtatgt ttaaaaatag 14521  ataaggtata ttttgcttaa aggcagtaag gctataaatt tgagccatag cttctctgtc 14581  agtattccac aatatctctt ttaacagttt ggagaaaagc tgtaatgcca gaagatacag 14641  tcaccaactc tagtttaaaa agtaacagat caaataatt tagagataca gcaaacactg 14701  aacatttgta gaacatagaa acaatgtacg tgacctttgg tcttgaggct atggctcacc 14761  aaacaggaaa tgccattccc tcctttccct gtggttctgg atgccaactt tacctgttcc 14821  cttttgccct agatactgtg gatgatactg ttagtagcga atcgcttcag tctttgttct 14881  cagaatggga caatccagta tttgcccgtt atccagaggt gggtctgtag cagttttct 14941  ttgcctttt tttttcttct tcttcttctt atttttaaa ttttgagatg gagttttgct 15001  cctgttgccc agactgaaat gcaatggcat gatctcggct cacgtaacct tcgcttccca 15061  ggttcaagca attcctctgc ctcagtctct cgagcagctg ggattacagg cacctgccac 15121  cacgcccagc gaattttgta tttttagtag agatgggggtt tctccatatt ggtcaggctg 15181  gtctctaact cccaacctca ggtgatctgc ccgcctcagc ctcccaaagt cctgggatta 15241  caggtgtgag ccatcacgcc cagccttct ttgcctgtta ttttaaactt tgagtttcaa 15301  gatgggtaca gtggcatgca cttatagtct cagctactca ggaggctgag gtgggaggat 15361  cacttgaggc cagaagttca aggctatata gtgtgctgat tgcacctgtg actagccact 15421  gcacactata gcctgggcaa cacagtgaga ctccatctct aaaaaataa gtaaattagt 15481  taaaaataaa atttgaattt tatttaagct gggtatgggc atgcaagact atattaattt 15541  gtaattatga ttggaaactg gcatatttc caaattatgt atttggaaat tactgtttaa 15601  tgtagagggg agaaataaaa tttatagcat ttgggaactc aggcattttg gattaaacat 15661  gtataatcaa tgtgagaaca gtgaatgtgt ttaccactct cagaaaccct gacttgtagc 15721  tttggcacag tattcagggt ggtgataatg aaattgttat cattagataa agccacacat 15781  cttctactgg aggaacagtt cctcattggc cccgcatgga tgttctctcc tcagtgtatt 15841  ttcacagaat gtactgtgca tgttataaac agggtgtata atagatgagc atttgtttac 15901  cagttctttc ctcaagatat catttgagga cttgatcatg gaacatagac aaattgttgt 15961  tgtgaaacaa tttttttttgt tttgtcagta attttgttta taagcaaaaa ttttttatgta 16021  agactcatta ttcataaatt cttttgaatt tttttttttt tttttttttt tttttttttt 16081  tttgtgacag agtcttgctg tgtcgcccag gctgaagtgc agtggcgtga tctcagctca 16141  ctgcaagctc cgcctccgg gttcacacca ttctcctgcc tcagtctccc aagtagctgg 16201  gactaaaggc gcctgccgcc acgcccagct aattttttgt attttttagt agagatgggg 16261  tttcaccatg ttagccagga tggtctcgat ctcctgacct cgtgatctgc ccgcctcagc 16321  ctcccaaagt gctgagatta caggtgtgag ccaccacgcc cggccgattc ttttgaattt 16381  ctataaattc cctgaattaa acccacctct agtaggctaa ataaaaatga atgctttaa
```

```
16441 agcactctga tatctttggt aaaacaattc tgacacaaaa attaaaattt caattatatt 16501 ttgctgagtc tttctaggtt gctgttgatg taagcagtgg ccaggctgag agcttagcag

16561 ttaaaattca caacatcttg tatccctatc gtttcaccaa aggaatgatt cattcaatgc

16621 aggtaaaaga ttaacttcaa atctcataa atatatatat atatatatat atatatatat 16681 atatatggcc taactcttct aaaatttgat ttatttaatg atatagacca ccttggtcaa 16741 ggcacgtgtg tgtgtgtgtg tgtgtgtgtg tgttcttact agaactttta tcatcagaag 16801 aaaaagcaag ggattaatta taattacaaa gaaagaaata tctttagtag tgtaagtagg 16861 tttggaggga atgaattatg gattcaggct gacagtttca aggattctca aggttctcct 16921 gcagaagatt atatattgac tttatatttg gcaataattt ataaatcaaa gtcctttagt 16981 gaccttgtcc ttaagtgtgc aacagtgccc ttttagaaat taccttctat tgtgtgagcc 17041 tacacaggtt tgggaaagcc catattgaga agtcatttca caaagggac cctttgtctg 17101 atctgctttt ctattttgcc ttgtgtttac caccatggct gtcttattcc ctttgttttc 17161 agtacggaaa caaattagga ggctaacaaa tttgggtaaa ctcctaacct ggcattgacc 17221 tggtaccaga gcaggcaagc agttgatcca gaaatagacc ctggggcagt ggtataggct 17281 cggggtatt ggagagcctc aagtacctag acagagagga accaccaagg tctaaagcca 17341 ccagtggctt ttaacttact tctttaatag actagcagcc gggcgcgctg gctcacgcct 17401 gtaatcccag cactttggga ggccgaggtg ggtggatcat gaggtcagga gttcgagacc 17461 atcctggcta acacggtgaa accccgtctc tactaaaaat acaaaaaatt agctgggcgt 17521 ggtggcgggc acctgtactc ccagctactc gggaggctga ggcaggagaa tggcatggag 17581 gcaggagaat ggcatgaacc caggaggcag agcttgcagt gagccgagat cacaccattg 17641 cactccagcc tgggtgacaa agtgagactc cgtctcaaaa aaaaaaaat taaaaataaa 17701 taaaaataaa aatagactag tttctccata atcgttttcc ttgctttcat ataaattta 17761 aaaatttatt tcagcctgta tgttagcaat ctctggtcac attacctatt ctcaagagtc 17821 actctgttgg gaacatctca ggccttctct aaagtattgc tagcacacca ctctgagacg 17881 tgggagtctg tcttcccctg tcgcctccct cccttacat cttctgatca actccacctg 17941 cccattcttt catccttcct agtgactttt tctggttcat cagaacctta cccagtctca 18001 aagaaaggag tgtgataagg caaacaactc taaataaaat acagttctgt atctttctat 18061 gcaaataagc ctttgttaat ttttatttag tgttgtacca cttatttgaa tgtctgacag 18121 gttctccagc aagtagataa caagtttatt gcctgtttga tgagcactaa gactgaagag

18181 aatggcgagg caggtaagaa tggagtttag cctgaatgat taaccagctg gtcttcttgt 18241 aacctttttt taatgattat ttttggtata taatatagtt tcaatgattt ggatggatta 18301 gggaaagcca atctaaaact aagaatatta tgaaggctgg gtgcggtggc tcacacctgt 18361 aatcccaaca ctttgggagg tgaggcaggt ggatggcttg aggccaggag ttcaggacca 18421 gcctgagcaa catggcaaaa ccccgtctct actaaaaata caaaaattag ctgggcatgg 18481 tggtgtgcac ctgtagtccc agctactcag gaggctaagg cacaagaatc gcttgaactt 18541 gggaggcaga ggatgtagtg agccgagatt gcgctattac actccagcct gggcgacaga 18601 catttagttt tatgttcata cacatacata tactcaggat gcacattaaa ctatcaagag 18661 tatttacttt gggagtgaaa atgagggtgt gcaaaggaga tatttcaact tttactcttt 18721 ttgtcttttt ttttttccttt ttgtggagaa cggggtctcg ctatattgcc caggtaggtc 18781 tcgaactcct gggcttaagc tatccttcca cctctgcctc cctaacagct gggattacag
```

-continued

```
18841  gtgtaagcca ccacgcccag cccatctttt attcttttaa atattttcta ttgtttgact
18901  ttttaataat attttcatgt tttcccttta taataataga aagtgtatat aatgaactct
18961  gctaggtttg tcaatattta cacagaatct cttggtgacc tgctctaatg aaacaataat
19021  agtttgtaaa tatattaact cattcaacaa gtattaattg agtgcccatt gtatgccagg
19081  gactgtacca ggccctaggg atacaataat gagaaaagat atatatgcaa gagaaaaaaa
19141  taattacaca aacataaaat tttagttcta gccctgtaa tggagaaaga gatacaagat
19201  gctctaagaa cctgtattgg gagatttgat ttcatcaggg agttcaggga agtgcttctt
19261  ggtaaaatga ggtctgaata tgaatatgag ttaactaagt aaagaaagga gggaacaacc
19321  atgcaatttg tgatttattc tcctcagtga gtggaaacag ggcaagggga actggagatg
19381  aggctagaga agtaggtagg agtcagatct taaatgccag ctacaagctt gctttgtcc
19441  caatactgtt ggaaaccatt gaaagctttt tttttcatt tttatcatt tgtattttga
19501  tgttgttttt ggggtggtac atgtcacatc acatttgcat tttaaaaga ttgctctggt
19561  tgtagtgtgg agaatggagt aggagtaggg gtggagtccc agttaactgt agattgactg
19621  ttaaaagaat attgcaatat ctgagacatg gttagatggg accagggtgg actagagagc
19681  agtgaatgta ttggaaagat atttaggaga tagagtcagc agggcttggt gatggattgg
19741  atatggggaa agtatgtaaa agatgacttc tggtgttctg gcctccatag ctgagttgat
19801  gatgttgcag gacccgtgtt gcaggcagag cagagaggat gaaaatcatg agttcagtct
19861  ttgaaatgct ccagaagaga tgtcaaggtg gccaggcacg gtggctcacg cctgtaatcc
19921  cagcactttg ggaggccgag gtgggtggat cacctgaggt caggagttga gaccagcctg
19981  gccaacatgc tgaaacgctg tctctactaa aaatacaaaa attagctgga catggtggca
20041  gatgcctgta atcccagcta ctcgggaggc tgaggcagag aattgcttta acccgggagg
20101  cggaggttgc agtgcgccaa gatcgcacca ctgcactcca gcctgggtga cagagcgaaa
20161  ctctgtcaaa aaataaaat aaaaagatgt caagaatgtg gttggatatt acaagtctgg
20221  cctagacaag tgttctgaca tggagataca aatttgagcc atcagatgca gaaagtgat
20281  cactgaaacc ctggatataa atgttatcac ctagaaaaaa gaagagtgag gagaggtctt
20341  gaatctagaa taattctagc acttaagagc tcggtagaag aggatgaacc agcaaaagag
20401  actgtgaaag aacagctaga gaaataggaa gaaaacgaaa gaatgttatg ttggaaaacc
20461  aggatgtcat gccaaacgct gccaagacat taagtaagat gaggatcatc tgattttgtg
20521  acagtagaga ttagggattt tagcaagtga gagctgtttc agagaataga caggacgaga
20581  tgctgatggt gctaatggag actgcaagga gatactcaga aatgtgccca tgacacggaa
20641  gagggactac agagggtgag ggtgacagag gaccttttt ttttaatggg agaaacttga
20701  gcacatttgc aagggatgcc tgatgggata aagtccctga aaaggcctga gtggctgagc
20761  cctgagcagc agtggagggc tggctccagc ttgatagtac ctgcaggcaa gtgctaaagt
20821  tttagagcat ttattctcta tgtatttcaa aatattccct ttaccttgtt tagtaaatgt
20881  catagcagat caaaggcaaa ttaacctaaa gttctgtcag aatttatcatg aatatagaat
20941  ttgtgaagat caaattccta tagttttact atttctagaa aagtaatagt tttttgttgt
21001  tgttgttttt gagacgaagt ttcactcttg ttgcccaggc tggagtgcaa tggtgcaatc
21061  tcagctcact gcaacctccg cctcctgggt tcaagcggtt caccagcctc agccttccaa
21121  gtagctggaa ttacaggcac ccgccaccca cgcccagcta attttgtatt tttagtagag
21181  acggggtttc tccatgttgg ccaggctggt ctcgaactcc tgatctcagg tgatccgccc
```

-continued

```
21241 gccttggcct cccaaagtgc tgggattaca ggcatgagcc aacccgcctg gccaattttt
21301 ttttttaagtt ttcattatct ggaattcttt gttgttttg agatcagaat ctctactaat
21361 gatactcaag atgggtgtaa ctacaaaatc tgcagatgtt gaaagaagca aaatggatct
21421 gttgaaattt ctcttttttt ctttactttt ttttttttt ttttttttt gagatggagt
21481 cttgctctgt cgcccaggtg ggattgcagt ggtgcaatct cggctcactg cagtctcccc
21541 ttcccgagtt caaggaattc ttctgcctca gcctcccaag tagctgggac tacaggcacc
21601 tgccaccacg cccggctaat tcttgtattt ttagtagaga cagggtttca ccatgttggt
21661 cagctgatct tgaattcctg acctcaagtg atctgccctc ctcagcctcc caaagtgttg
21721 ggattacagg catgagccac aggcccagcc agaatctgtg ttttaataag atccccaggg
21781 ggtatgtgat atgaacgttt gagaagccca agtctaaggc aggataaaca tggcccgagg
21841 ggaatctggg catcacctct ttctgtacag ccagggagat gggaatggtt tttacatttt
21901 ttaatggttg ggaaaaaaaa agaagactat ttcttgacac attaaaatta tatgaaatta
21961 gtatttcagt gtccataaat aaagttttat tggaacacag ctacgatatt cacatattgt
22021 ctatggctgc tttggctcaa aagaattgt tgagtaggca tgacagaaat cgtgtggccc
22081 aaaaagccta aaatatttat gatctggccc ttcagaaaac gttctccggc ttgtgatcta
22141 aagtgcactg gaagtacatt ctttgtgggt ttccaagtag cttgtacacc aaggttagct
22201 gattataaca atgtgttgtt taacgatcct ttatcatatt aaagttgaat taataaggca
22261 aaatcagtat ttaaacataa gaattatata ttcaagcttc aaacttgagg aaatgccact
22321 ttgactttt tttttttttt taagatggag tctcactctg tcaccaggct ggagtgcagt
22381 ggtgcaatct cggctcactg caacctacac ctcctgggtt caagcgattc tcctgcctca
22441 gcctcccaag tagctggaac tacaggcgcg tgccaccaca cccagctaat ttttgtattt
22501 ttagtagaga cagggtttca ccatgttggc caggatgatc tcgatttctt gacctcatga
22561 tccgcccgcc tcagcctccc agtgtgctgg gattacaggt gtgagacact gcacccagcc
22621 ctgactatgt tttctaaatg agatgctggt gaactaaaga gtttcttagt ttacctttg
22681 tttcctaaaa aatgaaatta tggggaaaat aataaaactt ataggataaa aattagtaat
22741 actggtaatc tctggagaga gaaactagaa ggggtggggg caagagtata aaggagactt
22801 tattaaattc ccttttgtgc ctttcagaat tggatctggg attcaaacat atgggataag
22861 tttgctatca tttttcccat aatttcatgt tttaggaaat aaaagataca attgttactc
22921 ctcagaatgt tttgtcttat gctgttgtta gatagtttga attaagtctt ctctgtcctc
22981 aacacacatg atggttgtcg tcttgctctg agaatcaaag ttcacaatcc ttgctcatct
23041 ag*gtgggaac ctgctcgtgc tggtggatca gcacgctgcc catgagcgta tacgtctgga*
23101 *gcagcttatc attg*gtaagg atctgtttgc agccagaaaa aatttgagac tcccagcaga
23161 atcagtacac ctcaaagagc ttttctaact gcaactgttg tgagaaagca cactttgtac
23221 tgtatgttca aaaattaaac taaagtcctg cagtttggcc tgtgttataa ttgaaagaat
23281 gtggtagttc actaattgaa agatgtgaac ttatttatgt ggtcagaggc atatttgcca
23341 gatgttatta acaacccaga agtacgcaag gataggctgc ttactctgac atccagcaca
23401 aagctctgcc cctccatatg cccggtgatc ttggcatgcc ttcccacact ccatcaggca
23461 gagaccagtg gcagctcaga aggcccagta tgctgttttg attttaaaat ttagtttgct
23521 tttgaatatg cagtataatc aaatagatcc aattctgaaa ggcacaaaag ggaatataat
23581 aaagtctcct ttctatcctt gtccccaccc ctcctagttt ctctccccag agacaaccaa
```

```
23641 tatctctggt ttttaaatct atctttccaa agcaatatat gcttttaaa tgtttttttt
23701 tgctacccct ttcctcatca tgaggcagtg tgttcaccaa gtggtaaaat accaggaaag
23761 tctttactcc tgtggccaat gagtaatgtc aaagagttag gcaaggacct aaggagtgct
23821 tcatggacta gaatggcaat gatattacta ctgttttcac ttttccttat aaaatgacgg
23881 cctaagagtt gggaaagata tagtaaaaac agtgttagaa aaacttacct ctacaggccc
23941 tgcaccattt gagaatagta ctaattctct ccagagactg ggagaccctg ctcaaggaaa
24001 gggaagcctt ctggagccat aagactgtgt ggtcaaccca catatgttcc tggtaatcca
24061 cattattcac ctctgtcatc aaaacaacat ttattaacta caggaacatt ggcttgttca
24121 tctgaatgta agatgcaagt cttatatttc ttattttgaa aaatactacc aaaattgtta
24181 ataggctgaa tatttattag tttgacttta aaaatggaaa tccaaaatct aaaactgaac
24241 attaaacatt ctgctttgca ttagaatgat tatctcaagg ccgtgcttta ttttttatctg
24301 aatctagaag acttcccttc ctactcttaa cccattcatc tttctgccaa tag*attccta*
24361 *cgagaagcaa caggcacaag gctctggtcg gaaaaaatta ctgtcttcta ctctaattcc*
24421 *tccgctagag ataacagtga cagaggaaca aaggagactc ttatg*gtcag taccaccatg
24481 agaatgtgat gttgatggta tcaattctca caataattct gtgaggaata agcataacta
24541 ttgttccatt tctcagatga gaccaagaga ggttacaaga cttgtctaag gtcatagcag
24601 ttattaagta gtggagcagg cactcaaagg caggtcgtct gactccacag gctgtttgtt
24661 tcctttttta aaatatattt ttttctgcat ccaatcatcc attaaaatat ttatttttgtg
24721 agacatggtc tcactctgtt gtccaggctg gagtgcagtg gcacaatctc tgctcactgc
24781 aacctccacc ttccaggctc aagcagtcct cccacttcag cctcccaagt acctggaact
24841 acaggtgagc accaccatgc tggactaatt tttgtaattt tttggtagag atgggttttc
24901 gccatgttac ccaggctggt ctgaactcct aggctcaagc gatcctccca ctttggcctc
24961 ccaaagtgct gggattacag gcgtgagcca ctggacccag cctattcttt ccactgtatc
25021 ccagctgaag agtataggat agagtttccc tgataatttt ttccagcagt tggcttagaa
25081 cactcttctc atttcttgga acagtctgtg tttatgccat gctttgtgaa agcaaagttt
25141 ctgcagtaat tggtcccatt ctgctttgct ttggtgcatt ctagactctt agttttcatt
25201 atcgtaatca taatgggaag aaagtaaaac attgggatgt aaggaagggg cgaatcatat
25261 agtgagtcac aagataggat attttttcctc ttctaggcag cacaaattat tgaaaatgaa
25321 aaagaaattt ctcccaatat gtttcaggtt tgggaatatg atactgccag taaatctttt
25381 tttccctatg acataattta tattagaggc agatctattt acttacatcc cgttagtcag
25441 gacttctcaa ttccttgggc tgttaattac ctccctgctt taatgctgat tcaaatcact
25501 ctcagacctt ttcttcatgc cagactccct taagtgccag cagccagaag ttagcagttc
25561 ctcaatgaag aaaacacact tagaaacaag acttagacac agattgattc ccaatggaaa
25621 agagaaaaac aataaaggtt actgtaattc aaaaaggaaa tttgataata aaaaatccca
25681 aacacccaca cataagtgtg agaaaaacaa tacggttgtt aagccctgtg gcagcttttg
25741 aaaactatt aagtagtatt tggaaccagt agtgaagtgc aaatgaagta gcactctttt
25801 tttttttaac atttgaggtt atctctttag *gtgttaccac aaaaatctgg aagatctggg*
25861 *ccttgaattt gtatttccag acactagtga ttctctggtc cttgtgggaa aagtaccact*
25921 *atgttttgtg gaaagagaag ccaatgaact tcggagagga agatctactg tgaccaagag*
```

-continued

```
25981 tattgtggag gtaagacaca gctgcagatg ttaaggaaat tgctgagtga tggtaacctc 26041 atattttgtc tgtagattct ctgaattcat cttttcttca acaagtattc atggtattta 26101 cctgcggtgt gccaggagct agaaattcag agatgagtta gctcaaaata aggaagaagg 26161 gcatttaaag aattatagtc agtgaacttt ggctagtaga ggtatgtgtt ttgctttctt 26221 cccagtgata aaggtaatga aaactaagag tctagaatgc accaagatag tttttcagaa 26281 gtgttatgga aacacagaat gacttgtgtg cctggggagg tgaagtcaat gaaaatgtca 26341 cagaaaagct gttttcttaa gaaaagtttt tacttttgag agaccaggtc tcactctgtt 26401 gcccaagctg gagtgcagtg gtgcaatcat agctcactgt agccttgatc tcctgggcac 26461 aagcaatctt cctgcctcag cctcccaagt aactcggact acagacacgc accaccatgc 26521 ctggctaatt ttttcctttt ttttttttgt agagatgggg gcctcactat gttgcccagg 26581 ctggtcctga acttctggcc tcaagcaatc cccttgcatt ggcttcccaa accccggca 26641 ctacaggcat gagccactgc acacagccag aaaagtctta cagaatagtg ggaaactagg 26701 ctgggcaagg tggctcacac ctgtaatgcc agcactttgg gaggccgtgg tgggtggttc 26761 acctgaggtc gggagttcga gaccagcctg acaagcatgg aaaaacccca tctctactaa 26821 aaatagaaaa ttagccgggc gtggtggtgc atgcctataa tcccagctac tcaggaggct 26881 gaggcaggag aatggcttga acctgggagg cggaggttgc attgagccaa gattgcacca 26941 ttgtactcca gcctgggcaa caagagtgaa actctgtctc aaaaaaaaaa agaaaaaaag 27001 aatagtggga aagtgctgag tacagaagag gggagaaggg cattctagac agaggaatac 27061 atatcagaga cttgagatac atcctatgtt tagggaacta tcaatagata tggctcaaat 27121 taagatctac agttgatcct tggataactt gggtctgaac tgcgcaggta cacttaaatg 27181 cagattttct ttcacctctg ccattcctga gacagcaaga ccaacctttc ctcttcttcc 27241 tcctccttag cctattcaat gtgaaaatga tgagggtgaa gacctttatg atgattcatt 27301 tccacttaat gaataataaa tatattttct gtttcttatg attttcttaa cattttcttt 27361 ttctttcttt ctttctttct ttctttttttt tttttttttg cgatgcccag gctggagtgc 27421 aatggcacaa tctcagctca ctgcaacctc cacctcccgg gttaaagcga ttctcctacc 27481 tcagcctccc aagtagctgg gattacaggc gcaccacc atgccccggc taattttgt 27541 atttttagta gagatggggt ctcaccatgt tggccaagct ggtattgaac tcctgacctc 27601 aaatgatcca cctgccttgg cctcccaaag tgctgggatt acaggcatga gccactacgc 27661 ctggccaaca ttttctttc tctagcttac ttaattgtaa gaatacagtg tgtaatatat 27721 acaacacaca aaatatgtgt taatcaactg tttatattat tggtaatgct tctgatcaac 27781 gttaggctat tggtagttaa gatttgggga aatcaggcca ggtgcagtgg ctcacgcctg 27841 taatcccagc attttgggag gccaaggcgg gcggatcatt tgaggtctgg agttcaagac 27901 cagcctggcc aacatgatga gaccccgtct ctactaaaaa ttaaaaaatt agccaggcat 27961 gatggtatgt gcctgtaatc ccagctactt gggaggctga ggcatgagaa ttgcttgaac 28021 ccggaaggtg gaggttgcag tgatccaaga tcactgcact gcactccagc ctgagtgaca 28081 cagtaagact ccgtctcaaa aaaaaaaaa aaaaaattgg ggggaaatca gaagttatac 28141 ttggatcttt gactggatgg gagttggcta gatgggttgt caaggtcaaa tcataaaata 28201 atttagcata ttctactaag tagtttgcat tttatcctat aggcagccag tgaaaacttt 28261 taagcaggag agtaaggtcc attttagatt gcattccaaa tatgattact ttacatatat 28321 gttttggtaa aggtttggaa agctactgct gggctgtggc attggaggta ttagagagaa
```

-continued

```
28381 ctattacttt ttattttgat tacttatatg tttctttttt tatagcaaat atcatttatt 28441 ttgtctttat tgtctttttc ctctccttc ctgtttctca ttatagttt ctgtatttct 28501 cttttttttt ttgctctact cgtttagaag ttatatatc catttatatc cttttagaga 28561 ttagccttaa cttttagcat gcatacttat caaagtttaa aagtaattca cttctctatc 28621 ctcttcctaa ctgtaccaaa atcttacaaa ctgttcatct cccatcaccc tcctcccatc 28681 ttccatgttg ctgtctagta ctttaattcc accttgtttt taattccctg gtggtcattt 28741 attttatagt caatctttat ttagattaaa aaagtgttc accagagtct ttgttcacca 28801 ttgcctcttg catcctactt attctgtgtt cttttgggtt ttttttttt ttttttttt 28861 ttttttttac tgaagtaaat ctcttacaag atcttttatc cacaaacaga tcttgagaca 28921 aaaaatacaa aaatataaaa ataaatagaa gttattttag taagagtccg tgggccaggc 28981 atggtggctc atgcctgtaa tcccagcact tgggaggcc aaggcgggca gatcacctga 29041 ggtcaggagt tttgagacca gcctggccaa cgtggtgaaa ccctgtctct accaaaaata 29101 caaaaattag ctgggcatgg tggcaggtac ttgtaattcc agctactcgg gaggctgagg 29161 caggagaatc acttgaaccc gggaggcgga agttgcaatg agctgagatc acgccattgc 29221 accccagcct gggtgacaag agtgaaactc tgtctcaaaa aaaaaaaagt ccgtgaatga 29281 taagctgtct tttaaagtat ctttatttg tcttcatact tgcatgatta tctagctaaa 29341 aacagaattt cacattgcca gttatccccc ccgcattttg aaaatatttc actactttg 29401 actttctatt ttatttttat ttatttcatt ttttgagaca gagtctcact ctgttaccca 29461 ggctggagtg caatgggatg atctcagctc actgcaacct ccgcctccca ggttcaagcg 29521 attctcctgc ctaagcctac aaagtagctg ggattacagg tgcccaccac cacacccagc 29581 taattttgt atctttagca gagatgggt ttcaccatgt tggccaggct ggtctcaaac 29641 tcctgacctc aggtgatctg cctgccgtgg cctcccaaag tgctgggatt acaggtgtga 29701 gccactgcac ccagcctgac tttctgtttt agccattgaa gtccttagtc aatccaatta 29761 ttactctgta ggtaatctga ttttccctct ggttgctttt acgatggttc actttgtctt 29821 tggtgttctg caatttccct atgatgtatc tttgtatgga tttatttca tttccttctg 29881 gagattcact atgcttcttc agtttggaaa gtatgcagtc attatcacct caaacgtttc 29941 tttcccattc tctctcttgt ctcttggaaa ttttgtcaga tatctactgg gccttatctt 30001 tctactctgc atgcctcttc aactctcttc catatttccc attgctttct ctctgtgata 30061 cattctgtga aatcctctca cttatcttcc agtgaactaa agtatctctt catcttctgt 30121 ttaattatgt gtttagctta tccactgagt ttttatttc agtgactaaa ttttttattt 30181 caatggctat attttttatt tccagaagtt gtgtttttt ccccaaatct cactcttcct 30241 tttttatggt gtcctgcttt tttcatgatt gttccttctc ctttatcagt agctttcttg 30301 atttggagca caggcaaatc cacacccacc tcatctagaa gtctgaagtc ctttagtaat 30361 atctaaaata gtaaaatcta aaattagagg atagatgtag tagataaatt ggggatgga 30421 tttatgtggg aagatttgag tcagggagag cagctgacgg gttattgcag tggttaaggt 30481 aagagaagat gaggattgga ctgagtcagt agcagaggga gtagagagga gtgacatatc 30541 tgagacagaa tttgggaggc agaagcaaga ggacttggtg agcaatcaaa cgtgaaagga 30601 ataaggaga aaacaaaagc aacagtgatt ctgagggttg tagcatggat ggctggaagg 30661 atggtggtgc cattgacaga gaagggacac agatgaggag gaacaaacct gcctaggagt 30721 tccatcgtga aggtgggttt agacacagtg aatgtgcctg caggtggaat gcccagtgga 30781 taggcacact taaaagatct ggtacttgga aaataaatct gggctgtaca tatctatctg
```

-continued

```
30841 agagttaaca gtatatatat attgatagta tcagaagctg gagaagggcc ttgaggaagt
30901 gaggttgtcc agggagaata tggagagtga aaaggaagag acaaaagagt ggagcctgtg
30961 gaacatcagc atccaggtg cgtatgcttt ggaaaaggtc tggaaagctc tgctgaaaag
31021 aggaaattct aaggatggct gaaaatactt ggttagagag ggaggaggaa aaccaggaaa
31081 aagcaatatt gccaaaacta aggaaagttt taagcaagga gggaatggtc aataacggct
31141 atgaagtaga gcctgaaacg ctggacttga ctgtcatgag gacattagtt gtcttgtgga
31201 atcatttcct ggggatgagg tggggcagaa gataagagtg cagtgagtca ggagtgcgtg
31261 aagcaggagg aagtgaagct aagtagacaa ctctttcagg aactttggct acacacagaa
31321 gaagagagat ggggtgagag ctaaaggtta gaagtggttg ggaagtgtgg ggtgggattc
31381 aaggctgagg aaaggtgttt gtttgcttta agacaaaaaa gacgtaagca ggtttgcagg
31441 ccaaggggga aacattcaag aggaagagca gctgtcagtc agctcttggg tcatcttggc
31501 tttgcccttt ccagaatcgc ctttggatca gacagatcca aagatttgct ctgcttccag
31561 caaagctctt tcctccccac agacatgctt tctctaagac ccctgctcca aattgtccta
31621 aatccaaaag ataggatctg ttagagtctt ttattgtaat tcaatcccta atatgtaacc
31681 agaaaattat aagaaaaact tttcctgaag gaacttaaaa gactactgtt aaggagtttg
31741 cttcaaatgg aaacaaacct ctggtttcat aaaatcttga ttatcctatg tcaggctgat
31801 caggagagac tttgtgtgat tctggaagaa gctggaacag ttttggtgtt ttgaggaggt
31861 agctatttga atcctagcag ttgaaagatc attaatacat ccttctataa agctctatct
31921 tctagcctgg tgaggaggtg gaggctgcag tgagctgaga tcgcgccatg gcactccagc
31981 ctgggcaaca acgagactac gtctcaaaaa attaaaaata ataaataaat acggccaggt
32041 gcagtggctc acaactgtaa tcccagcact ttgggaggcc gaggcaggcg gatcatctga
32101 ggtcgggagt tcgagaccag cctgaccaac atggagaaac cctgtctcta ctaaagatac
32161 aaaattagcc aggcgtggtg gtgcatgatt gtaatcccag ctactcagga ggctgaggca
32221 ggagaatcgc ttgaacccag aaggcagagg ttgcggtgag ccaagatcgt gccattgcac
32281 tccagcctgg gcaacaagag tgaaactcca tctcaaaata agtaactaac taactaaata
32341 ataaataaa aaataaaata aaaatattaa attatccagc attaaacaga ccattggaat
32401 ataaaatgga ctgagatgag acccatcacc ccttcactaa gcttacaaac agatgtttta
32461 ccatcccaga tgtacaaaca caagaatgtt tgctctccat ccacactaag ctttgtcagt
32521 ggattgagtc ttatgagacc atctttctgt ttaggtttgt ttgggaaaac atgtgatttt
32581 taaattatat gtaatatagt atctactacc tagctcttga taactgtgcc catttatagg
32641 catggcagac tagagtatag atgaaggagg gaagagaatt tcctgagtct ggttttaaaa
32701 gaaaaggtac catgttgtaa tcttaggagc agatttacac atagccttt ccaggagtaa
32761 agaaatgatt ttcttataaa gaaatcatta aatgtgcaac aggttttttt cttttacct
32821 ccagaggtta aacaaattgg tagcatgaaa tagtgtctgc tttaaattc tttaagcttc
32881 ttttgtaaat attaatatcc acagggatat aactattgaa aaggttaccc cagggacaga
32941 gacatgcaag ggaggagaaa tttctcaaca aagggcctca gaaaataaac tttctgacct
33001 gaagggaatt gtccccaaaa agcccgtggg aactaaagtg actgtttact tatgtttatg
33061 atatttaagc aagtgtttata ctgagcagtg gttgtgttga tggttgttgt gtatttattc
33121 tcagtttgtg tgtaatatta cgcttgttct ggctaagatt acacacacaa acagacagcc
33181 ttttagtgag aagccttcct gatgtttga attggttgaa tcatcaaggc tactctcacc
```

-continued

```
33241 agctacataa cctcattagt tgagaagcta tctctggagg aagtctcagt agctaaatat
33301 attctgtgtt caataagagt tctattcagt tgcttggttt tttcatattc aaagtgcctt
33361 acaacaaata aatttgtacc caagtgctgt attgctggaa ctctttcttt caggaggcat
33421 gatttaaaga agaaaattga gatattttgt aaactatcaa agggcaagta aaacataacc
33481 gtagattaaa gccgattttc cttttgcttt gcaggaattt atccgagaac aactggaggt
33541 aagcttttcc tttattttgg ggtttcacac agaagcacca cacataaaag gcttcgttgt
33601 tccgttttct tttcctgtta ataacgtgtt tatgcattag ctactccaga ccaccggagg
33661 catccaaggg acattgccac tgactgtcca gaaggtgttg gcatcccaag cctgccatgg
33721 taagcccttc aacatagcag tgatcaaaca cctctgcatg cagagccctg cagggctgc
33781 cgggattaca aaagaggcag agggtacatt tactacttga ctcttggaga atacaattta
33841 gatcaagaaa ctgaatatac cctttttaaaa atcactttta caaaaacaaa atcccaacac
33901 aaaaatttga ctatagtgct gcctgaccta tatgagtgga ggaataactc ctagaggaga
33961 tgcattttga gatgaatttt gaatgagctg gggaacatgg gttcatagca tggaaagggg
34021 aattcactat agggagagta aacagcctgt gcagagaggc agaacagaaa caagttagtt
34081 atatgagaag cagcaaagag tatcaagaaa ctaggcaggt aagagaacag aaacctagaa
34141 ggtcacagca aaacctttgg atttgataca gaaggcatta gaattagcaa gcgttctttt
34201 tttatctttc caactttcat tttaggttca gggggtacat gtgcactttg taacatgggt
34261 gagttgcatg tcgcaggggt ttggtgtaca gattattttg tcacccaggt aatgagcata
34321 gtacccaata ggtagttctg atcctcaccc acctcccacc ctccacccctc aagtaggccc
34381 aggtgtctgt tacccccttct ttgtttctat gtgtattcaa tgtttggctc ccacttttaa
34441 gtaagaacat gcagtatttg gttttctaat tcacttagga tgatggcctc tagctctatg
34501 tttttgcaaa ggatgtgatc tcgttctttt ttatggcgac atagtattcc atgatgtata
34561 tgtaccacat tttctttatc caatccacca ttgatgagca ttgaggttga ttccatgtct
34621 ttgctattgt aaatagtgct gcagtgagca taacacatgc atgtgtcttt atggtagaat
34681 gatttctgtt tctttgggca tattcccagt aataggatta ctgggttgaa tggtagtttt
34741 gctttaagtt ctttaagaaa tctctaaact gttttccaca gtggctgaac taatttatat
34801 ttcccaccag cagtgtataa gtgttctgtt ttctttgcag cctcaccagc atctgttatt
34861 ttttaacttt ttaataccag ccattctgac tggtgtgaga tggtatgtca ctgtgatttt
34921 gatttgcatt tctctaatga ttagtgacat tgaacatttt ttatatgctt gttggccatg
34981 tgtatgtctt cttttgagaa gtgtgtgttc atgtccttg cccatttttt aatagggttt
35041 tttggttttt gcttgttaat ttatttaagt tccttataga ttctggatat tagttcctta
35101 tatagattct ggatattaga cctctgttgg atgcagtttg caaatatttt ctcccattct
35161 gtaagttgtc cgtctattct gttgatagtt tcttttgctg tggagaagct ctttagttta
35221 attaagtctc acttgtcaat tttcgtttta ttgcagttgc ttttagagtc tttaccagga
35281 aatctttgcc aaggcctacg tccagaatgg tatttctgag gttttcttct agggttttg
35341 taaaaagatg gaatgcgccc aggcgcggtt gcttacgcct gtaatcccag cactttggga
35401 gaccaaggcg gatggatcac ctgaggtcag gagttcgaga ccagcctggc caacatggtg
35461 aaaccccatc tctactaaaa acataaaaat tagccaggcg tggtggcggg cacctgtaat
35521 cccagctact caggaggctg aggcaggaga atcacttgaa accaggaggt agaggttgca
35581 gtgagccaat atcacgccac tgcactccag cctgggtgac agagtgagac tccatctcaa
```

-continued

```
35641 aataataata ataataataa taataatgaa gatggaatgc ttcatgaatt tgcatgtcat
35701 ccttgtgcac ggaccatgct aatcttctcc gtatcactcc aattttatta tatgtgctgc
35761 caaagcgaac accattgagg gttcttgagc agggtaatat gatacaatat agaaaatggg
35821 gagctgggtg aggccctgtg aggaaggtgc ctgcttctcc ttcaccttcc gccataattg
35881 taagttttct gaggcctccc cagccatgca gaactgtgag tcatttaaat ggtctttcct
35941 ttataaatga ccgagtcttg gtcatttctt catggcagtg tgagaacaga ctcatactcc
36001 tctatcacca aatgtcatca ttgccacctt caaaatgtat cttcggtccg tctgattcag
36061 tctgtctggc tcctccctca ttttgccac tgttgagctc tcttacttag ttcttcacat
36121 ccactctggc tccctttcaa gctgctcttc tctcagcacc cagaggaatc ttttgaaac
36181 atccctccaa gcatgttgtt cttctaacta aaatgtgtca atgatgaccc attgctcttg
36241 ggatagaaat gtgattttt actgtggccc acaagggtct tcgtgatttg gccctgcct
36301 gcctctccag tgtcacgtca tatcactctc caccttgttc tttacatccc agcctgcttt
36361 tttggtcttc tgcttcctgt gtgctaaaca tttgtcagcg tcggggcctc tgcactggcc
36421 ttctcctcta cctgaaacac ttttctctcc ttcttcaatt agccacgtct ttcttaacct
36481 aaagtctcag cttgaatact actttgccag gaaagccttc cttaagctcc taaactgggt
36541 ttggtcttcc tattatatat tcatatcctg tattttatag cacctatatt tatcatttaa
36601 attattgtat aattatctgc ttcatgtttg tctcccctat tagaccataa gcgccatgag
36661 gatggaaatt atctgtctca ctaactgcct gacaaagctc ccaatacaaa gtatatactt
36721 aataaatatt tgttgactgg gtaaattgtg cataaaggca ggttataaca atatgagagt
36781 ttagattagg aagattatta tggaaattag aaaaaaagaa gcaaataaaa tgaacattgt
36841 aaggaaacaa tcagagattg ctattggacg atccatggag aaagataacc ccaacttcac
36901 aaacccataa agagtaggca aaaatactgc tcttgcctct tggagaaaaa ctctgaaagc
36961 cagatcctaa caagttaagg aatgcctcct acagagatta gaaatacaaa tactccgtaa
37021 gaaaaagctg agagacagaa ggtcagtcct gaagccttag tttcatccat ggtcataagc
37081 actaatttat ttccctcttt tttttttttt tttttttttt ttgagaacgg agtctcgctt
37141 tgttgcccag gctggagtgc agtggcgtga tctcggctca ctgcaacccc cgcctcctgg
37201 gttcaagtga ttcttctgcc tcagcctccc aagtagctgg gactataggc gcgtgccacc
37261 acacccggct aatttttgta ttttagtag aggcgggatt tcaccatatt ggccaggctg
37321 gtcttgaact cctgacctca tgatctgccc gcctcagcct cccaaagtgc tgggattaca
37381 ggtgtgagac accatgcccg gcctataagc accaatttca agcaggatta aagcttcatt
37441 aaagaagcct aagaaacatg ttactttttc cagatatttg gcagtgaccc aaggtcagca
37501 ttggtttccc actatataca ctataacctt cttgtttctg tctttcattt ag*ggccatt*
37561 *aagtttaatg atggcctgag cttacaggaa agttgccgcc ttattgaagc tctgtcctca*
37621 *tgccagctgc cattccagtg tgctcacggg agaccttcta tgctgccgtt agctgacata*
37681 *gaccacttgg aacaggaaaa acag*gtacat taatgactaa caggagcagg agggagcaaa
37741 gtttattttc tctttctttt ctggcttta ctatgcaact gtaatctgtc ttaacctttc
37801 caaaatagga gagttttgca aaatctgcac tggaagtttc acataaagc tcacccattt
37861 cattttccag ctcaaatcca aaatggaact tagactgaac tgtcaggtca cctacataat
37921 ggctttgtat tttaaaactt aacacatgta cagacttatg taccctgaat atctattgcc
37981 tgctggctct aggtttcata atatgcagtt ctttctgaag ctactgaaag ttggtagaag
```

-continued

```
38041 cacagcaaat tcactgttgg caatatagag cctcaacttc cagtttcttg atagtacctg
38101 ctggaaacgg tgatctgtga ctgtagctgg ccatcccaa ggatcttgag ttatggtttg
38161 aggatcatca gacagggacc caagcttggg gatctctaca ttatgctttg ccctaatta
38221 cccagcaacc tgcaaactac aatgtggata atgcagaaaa ggcacagaat ggcttaaatg
38281 aagaacttct gtccttgtta taatcttcag tgaaggagaa catggagaac ataacaggaa
38341 tgtccctgtt gctgctttcc aaaatctttc cttttttttt gttttttgag acggagtttt
38401 gctgttgttg cgcaggctgg agtgcaatgg tgcgatcttg gctcaccgca acctctgcct
38461 cccgggttca agcaattctc ctgcctcagc ctcccgagta gctgggatta caggcatgcg
38521 ccaccacgcc cggctaattc tgtattttta gtagagacag cgtttctcca tgttggtcag
38581 gctggtctcg aactcccgac ctcaggtgaa ctgtccacct tggcctccca aagtgctggg
38641 attataggca tgagccactg cgccctgccc aaaatctttt cttttgctaa ccttttccctg
38701 ctaagggata taaaatcttt tcttgcatgg agttttcagg tactaatgtt gtctgactca
38761 actagctgat tttacttcat taaaacctct ttgtttcaca agaaaaata tgaagaaagt
38821 ttttctccat tgctgagagc tgggaatcta gacttaaagt tctgagtccc cttggatcct
38881 taaaacaatc tgtaatctct attgaatcca gaagttagaa atctaaacag attataacag
38941 ccagactttg gaaatatttg tatgctacct acattttcaa tttttttttt ttgagacgga
39001 gtctcactct gtcgcccagg ctggagtgca gtggcatgat cttggctcac acaacctcc
39061 gcctcccagg ttcaatcaat tctcctgcct cagcctcctg agtagctggg attataggca
39121 tgcgccacca cacccggcta attttttttt gtattttag tagagacagg gtttcaccat
39181 attggccagg ctggtctcaa actcctgacc ttgtgatccg cctgccttgg cctcccagag
39241 tgctgggatt acaggtgtga gtcacctcgc ccagcctgta tgctacctac cttttcatat
39301 tgctaattga agttattctt tcttcccata gattaaaccc aacctcacta aacttcgcaa
39361 aatggcccag gcctggcgtc tctttggaaa agcagagtgt gatacaaggc agagcctgca
39421 gcaatccatg cctccctgtg agccaccatg agaacagaat cactggtcta aaaggaacaa
39481 agggatgttc actgtatgcc tctgagcaga gagcagcagc agcaggtacc agcacggccc
39541 tgactgaatc agcccagtgt ccctgagcag cttagacagc agggctctct gtatcagtct
39601 ttcttgagca gatgattccc ctagttgagt agccagatga aattcaagcc taaagacaat
39661 tcattcattt gcatccatgg gcacagaagg ttgctatata gtatctacct tttgctactt
39721 atttaatgat aaaatttaat gacagtttga ttggttgctt ggtttgttat ttgaagggtg
39781 tgatttttgt ttttgtacag ttttttttca agcttcacat ttgcgtgtat ctaattcagc
39841 tgatgctcaa gtccaagggg tagtctgcct tcccaggctg cccccagggt ttctgcactg
39901 gtcccctctt ttcccttcag tcttcttcac ttccctatgc tgctgcttca tgtgctacat
39961 ctcagactta aagagtttct ctactacagt gaaaacattc tctagggtct ttcatcaggc
40021 ctttagttat tttagggata aaaactattg ataaaagga caaggataga acagagaaaa
40081 tttaaagtcc tgttccgggt ttttgttat gttttcttta aaaactcaga gactgatgtt
40141 caatatccca aaccagtaaa atggtgaaaa tactatgagc ttgtttttta aaatatgatt
40201 ttttttggta ctttataaag tatctctttta tgtgaaagca attgtcatat caaaacacag
40261 catacatacg ttcaacctaa ccaaatatct ttacactttt tctttcagga gacaagggtt
```

-continued

```
40321 ctttgggtcc ctttcaaacg gtatcttggt gttattacat tatgcctatc tattgccctt 40381 ataatatcac ttgggaccag gactgatcgt tctgcaaatg cttgttatgc cattctcaat 40441 ctattttcc cgcacctttt cacatgattt gtggttaata ggactcaaca gactaaaatt 40501 gcatagtaga aaaaaatgc aaaaagccag ctggtaatgt ttattgcaac tggggtgcta 40561 tacaattagt aagatgatgc aatgagaatt tctactttg tatttcctga ccagcctgct 40621 caaagtggct tttatatcaa ttgaatgatt ttcctcattt tttaatacag gaaaccaatt 40681 cgtgctcatg gaagaaaagt tcctttgcca gcagccttga agtgaatctt acaggagcaa 40741 tgaaagtatt gcattcatta gcgtctgccc cagagaaggt tcagagaaaa ccttcacttg 40801 ttttcaaggg gatccttgta gatttacgta attggaatcc tgaagaacag gccctactgt 40861 ctaaaaaatg gcttttattc ttctaaatac atataaacgg atgttttata gatgggaaga 40921 catgacctta gaaaggagag agttttcaga ggatttgcca ggctgtcagg ggctctgcct 40981 ccaggcccag tgtggcagtg tggcctcagg gcctccgcct ccctgcttga gggctgcatg 41041 gaggccaact gtcctgggag ttgtaaaaat cttttaaggc cagaccaatt tgagggattt 41101 taaaaagtgt ctcagtgcct cttatgattt cagaaggttt tgctatatgt aatcccaact 41161 actgttttct tgagagtagc agaggattag aaaaagtcct ccataaatta tgtaaccggc 41221 cttcctgact agcctgactc aagcaatgta agagataatt attctgtttt cataatttat 41281 aagtgtgggg gcatgcctca gcataaaaac aacctattag ggaaaaatat ctaatagatt 41341 acctttatcg cctgttaggg ttttatgttg tttttaactc agatgccata gaacaaaga 41401 tacatgtaat ttataatagt aatcattaat acctatattg tgctttaagg tttacaaaat 41461 aattttctc atactttatc ttagtttagt ttcttgacag tccatgaggt aaggtggtag 41521 ctttatcacc attttacaaa gtgggaaacg aaggttcctc ttaggaacct agttgtcacc 41581 tttgtataat aaaacttcga agctcggagc tgttaactgg tttgctgaag gcttagctgt 41641 aagagccaga attcagaccc aggtctgagt gacttcaaac tgcacagtcc ttcccattat 41701 tacccatatg ctatccctta ttttttaat ttattaggaa ttcattcatt tataaacttg 41761 gtgattcacc tttattagat tctggtcgct gaaggcttta gtaacttcag agtaaaactt 41821 gagagatgag atgtaaaatg cagccattct tgagagttcc ttttctgta acattcatca 41881 acacttcatt gagaagtgaa ggttcctatg gctgtctcta ccttcaagag gcttagcttt 41941 agtcactgag aaagacaagg aaactaatga tagaatatag tagcttcttc tggcgttagg 42001 tatcacagag tcacagctag ttacagctag ccctttatta ttgaaagaag aggagctagc 42061 agtcccacta tcagaattaa gactagagat ggtaatagga gctagtatca gaaaagctta 42121 aggcaaagca taaagtgtag gctagaatga agctggagaa tggggagggg gcttgggtaa 42181 catccagaac ctggctgggg acctggaact acatgagatg taagaatgga gaggttctag 42241 cagtcagagg tcaggtacaa atgaacagct gggatctgcg catggcagac agtgaaaaaa 42301 cccaggcaag caaaatggtc agagcagaaa ggggcccaag gccacgttct tgagatgtgg 42361 aggggggctga ggaagccacg ccaagtaagg acagatgcag ctcagcagtt cctagcgagc
```

```
42421  cctgacaagc cagctcagct gaagcttcgg gtgggagcca gtcatggcac agtggagtga 42481  aggaagagca gtttcaggca cccaaaacct gaccccacg acctgttttc cacctgaaga 42541  gccacccatt ccatccaaac ccttggcaaa agtctgctaa cagagagaac cggccagtat 42601  gctggccagt cgcgatcatg cctgtcttta ccctctaagc tgaagctgct catcaacggt 42661  gagatggcaa aaggtgggt ccagaagagg ggaaaagaag ggagtctgtg aaaacaaaat 42721  gctgaagaat ctgcatcaaa taaacccttc cttccttcct ttttccttcc atccctctct 42781  tcattcagca aatcttcagt gagttccttt ctaaatgtat tgtatcagaa cttgtggggg 42841  atataaagaa aaaaagagg ttatcacatg gcttaggatg tttccaaccc ttggatcatt 42901  ttcaccccag gcccattagt tacagagcac tcagtcttac ccagaagcat cggatatagt 42961  ccaggcaacc ggatccaagc gtgtgggaat cgcagtgtgc tgcatgtggg aatctatcag 43021  gccaggatga ttcaagcagc agcctgcaga agtgggattt ggccagcctt gcctgactct 43081  ggccttccaa cttgctctta tctacttcca aagtaaggaa tgccccatga tgggccgagc 43141  agtccaaaaa aagtggcttg gagttagcta ccgcaattag cagtttctca ttattcaaca 43201  ctgcattacc tcttttcat attaactgca gaattttatt tttatgtatt tattatcctt 43261  ccaaacccag tgttgtagga agaatattac atataaatga taacttagga atcttgtcaa 43321  gttttgttt cttcagcact aagtagctta ttttctaggc aggtcttaat tctaaatgta 43381  acatgcttga aaaaaacact attgaaagga tccgtctctt cagcatagta tttaatatac 43441  atatcaggca atcaccatct caagcatgat tagactcaag tgctgccctc catcgtgtga 43501  gggatgctgg gagactggaa gcttagactt tagctctta agttggtgca aaagcaattg 43561  cagttttac tattaataat aataattgcc tagccattgt gcagtacctt gcaagagctc 43621  tttggcaaat gaaagaataa ttcaaagcaa agtaggccag atataaaaca cttccaaatc 43681  acatttcaaa attgttcttt catgtcaact aggtgcatgt ctgctaaggg agttttgca 43741  aggacaggtg gatagtgtga ggccttaca ataatcacat caccatctgg tactatctgt 43801  atggcagagc agttctgatg tagttgtagt attatagatc attacagagt atgccagtca 43861  ttccatgatg gaactgtgac tggcagcctt cattagccca aagactgatg caacagattg 43921  ctttgagaaa tagttttgaa gcacatccat gaaacatatg atcctatggg ttccagcatt 43981  gatttctttg aggtatcatt ttacacttca gttttcctg gtagagtatt tttcagagat 44041  gtctcttctg aggctaaatt aggaatttct gttccttatt caagttccaa gaattgtgcc 44101  tttcctgccc tctgcccaaa ctggaagata gaaaccgtgg gaaaaagtg tctttacaaa 44161  ctgcactgtt atctaacttg gtttatttag catattgagg aagactttca catccatgga 44221  atcctagttc tattaattct ctccaagcta caacagttgt ttttttgttt gttttttcc 44281  gagtttctcg gttccgccag caaggcaggg gtgggaggtg ggcacccctg ataccaaggc 44341  tgacaggtag tgagttgatg tggaacttct gtttcctcct gttcagttca ggttctctct 44401  ttctgatact tacccctcct caaataggga aacggagaga ggggaaataa gaagatgagc 44461  cttaataggg tttacttaat tggggtcata aagattctaa aaagtatgca ttcctgcagt 44521  tctgttctag gcactgtaag agctgaccag aaagagagct ctacccctta taaccttcat 44581  ccaactcagt catgcctggg aaggatgttg gtgctaattt tagacacaga gactaagatg 44641  gacaaaggac aagtatcata aagcattttt ggagccagga acagatttaa gttccttgcc 44701  tcactgctgc tcttactcca aaccacacaa ttgtacccaa gtgaattgct gttagaattg 44761  gtgcctttg
```

SEQ ID NO: 2 below corresponds to the reverse complement of chr14:75500097-75500218 that shows the sequence in the direction of transcription, where Exon 7 of MLH3 is underlined:

```
5'-aagttcacaa tccttgctca tctagGTGGG AACCTGCTCG

TGCTGGTGGA TCAGCACGCT GCCCATGAGC GTATACGTCT

GGAGCAGCTT ATCATTGgta aggatctgtt tgcagccaga aa-3'
```

The protein MLH3 (as half of MutLgamma) works downstream of MSH3 (half of MutSbeta) to cleave DNA near bound MutSbeta. MSH3 has variable expression, and is often absent in tissues that do not exhibit somatic repeat expansion. When ectopic expression of MSH3 is introduced, the repeat expands (A5). In one embodiment, MSH3 expansion can be inhibited by inhibiting the next step in the process, DNA nicking by MutLgamma via MLH3 isoform switching. While MLH3 has not been identified as a major contributor to cancer in humans (A6,A7) and MLH3 knockout mice were healthy and showed no susceptibility to morbid cancer in the first 9 months of life (A8), longer term studies have shown that complete loss of MLH3 throughout life increased the propensity for late onset tumors (A9) which was modified by loss of other tumor suppressor genes (A10).

Oligonucleotides

"Oligonucleotide compounds" of the invention can include oligonucleotides, e.g., Antisense oligonucleotides (ASOs), splice switching oligonucleotides (SSOs), siRNA, shRNA, and the like as well as modified nucleotides discussed herein that are incorporated into the same. ASOs are single stranded nucleotide molecules that are complementary to a target nucleic acid sequence. For example, "target nucleic acid" and "nucleic acid encoding a subunit of the MMR system" encompass DNA encoding a subunit of the MMR system, RNA (including pre-mRNA and mRNA) transcribed from such DNA, and also cDNA derived from such RNA, as well as DNA or RNA sequence described herein that further encompasses noncoding sequence. In one embodiment, the target sequence comprises a nucleic acid sequence encoding a subunit of the MMR system (e.g., MSH2, MSH3, MSH6, MLH1, MLH3, PMS1, or PMS2), where the nucleic acid sequence includes but is not limited to sense and/or antisense non-coding and/or coding sequences associated with a nucleic acid sequence encoding a subunit of the MMR system.

Hybridization involves hydrogen bonding, which may be Watson-Crick, Hoogsteen or reversed Hoogsteen hydrogen bonding, between complementary nucleoside or nucleotide bases. For example, adenine and thymine are complementary nucleotides which pair through the formation of hydrogen bonds. Hybridization can occur under varying circumstances. Complementary, as is understood by the skilled artisan, refers to the capacity for precise pairing between two nucleotides. For example, an oligonucleotide and the DNA or RNA are complementary to each other when a sufficient number of corresponding positions in each molecule are occupied by nucleotides which can hydrogen bond with each other. It is understood in the art that the sequence of an oligonucleotide does not need to be 100% complementary to that of its target nucleic acid to be specifically hybridizable. For example, an oligonucleotide can hybridize over one or more segments such that intervening or adjacent segments are not involved in the hybridization event (such as, e.g., a loop structure, mismatch or hairpin structure). Thus, "specifically hybridizable" and "complementary" are used to indicate a sufficient degree of complementarity or precise pairing where stable and specific binding occurs between the oligonucleotide and its target nucleic acid (e.g., the DNA or RNA target).

In one embodiment, the specific hybridization of an oligonucleotide compound with its target nucleic acid interferes with the normal function of the nucleic acid. In one embodiment, an oligonucleotide compound is specifically hybridizable when binding of the oligonucleotide to the target nucleic acid interferes with the normal function of DNA, the normal function of RNA, or the normal function and/or expression of the product encoded by the target nucleic acid, causing a modulation of function and/or activity. In one embodiment, an oligonucleotide compound (e.g., an SSO) can cause an intron to be retained. When an intron is retained, for example, the mRNA is de-stabilized and subsequently degraded. Thus, intron retention mediated by an oligonucleotide compound, such as an SSO, can lower expression of the target gene just like shRNA or siRNA.

The DNA functions to be interfered include, for example, replication and transcription. The RNA functions to be interfered include, for example, translocation of the RNA to the site of protein translation, translation of protein from the RNA, splicing of the RNA to yield one or more mRNA species, and/or catalytic activity, which may be engaged in or facilitated by the RNA. The overall effect of such interference with target nucleic acid function is modulation of the expression of an encoded product or oligonucleotides. In one embodiment, the modulation is a decrease or loss of the activity of the encoded product. In one embodiment, the modulation is a decrease or loss of expression of the encoded product.

The oligonucleotide compounds described herein comprise about 70%, or about 75%, or about 80%, or about 85%, or about 90%, or about 91%, or about 92%, or about 93%, or about 94%, or about 95%, or about 96%, or about 97%, or about 98%, or about 99% sequence complementarity to a target region within the target nucleic acid sequence to which the oligonucleotide compound is targeted. For example, an oligonucleotide in which 18 of 20 nucleotides of the oligonucleotide compound are complementary to a target region, and would therefore specifically hybridize, would represent 90 percent complementarity.

In one embodiment, the oligonucleotides are specific for polynucleotides of a subunit of the MMR system (e.g., MSH2, MSH3, MSH6, MLH1, MLH3, PMS1, or PMS2), which includes, without limitation, non-coding regions. In one embodiment, the oligonucleotide is an antisense RNA molecule. In one embodiment, the oligonucleotide is an antisense DNA molecule. In one embodiment, an oligonucleotide targets a natural antisense sequence (natural antisense to the coding and non-coding regions) of a subunit of the MMR system (e.g., MSH2, MSH3, MSH6, MLH1, MLH3, PMS1, or PMS2). In one embodiment, the oligonucleotide is an antisense RNA molecule. In one embodiment, the oligonucleotide is an antisense DNA molecule.

The oligonucleotide compounds discussed herein can also include variants in which a different base is present at one or more of the nucleotide positions in the oligonucleotide compound. For example, if the first nucleotide is an adenine, variants may be produced which contain thymidine, guanosine, cytidine or other natural or non-natural nucleotides at that position. The base substitution can be done at any of the positions of the oligonucleotide. The oligonucleotide compounds can then be tested using methods described herein to determine the oligonucleotide compound's ability to inhibit expression and/or function of a target nucleic acid, such as a subunit of the MMR system (e.g., MSH2, MSH3, MSH6, MLH1, MLH3, PMS1, or PMS2).

In one embodiment, homology between an oligonucleotide and its target nucleic acid sequence (e.g., the nucleic acid sequence of a subunit of the MMR system such as MSH2, MSH3, MSH6, MLH1, MLH3, PMS1, or PMS2) is from about 50% to about 60%. In some embodiments, the homology is from about 60% to about 70%. In some embodiments, the homology is from about 70% to about 80%. In some embodiments, the homology is from about 80% to about 85%. In some embodiments, the homology is from about 85% to about 90%. In some embodiments, the homology is about 90%, about 91%, about 92%, about 93%, about 94%, about 95%, about 96%, about 97%, about 98%, about 99%, or 100%. In one embodiment, sequence identity between an oligonucleotide and its target nucleic acid sequence (e.g., the nucleic acid sequence of a subunit of the MMR system such as MSH2, MSH3, MSH6, MLH1, MLH3, PMS1, or PMS2) is from about 50% to about 60%. In further embodiments, the homology is from about 60% to about 70%. In further embodiments, the homology is from about 70% to about 80%. In further embodiments, the homology is from about 80% to about 85%. In further embodiments, the homology is from about 85% to about 90%. In further embodiments, the homology is about 90%, about 91%, about 92%, about 93%, about 94%, about 95%, about 96%, about 97%, about 98%, about 99%, or 100%. In one embodiment, complementarity between an oligonucleotide and its target nucleic acid sequence (e.g., the nucleic acid sequence of a subunit of the MMR system such as MSH2, MSH3, MSH6, MLH1, MLH3, PMS1, or PMS2) is from about 50% to about 60%. In another embodiment, the homology is from about 60% to about 70%. In another embodiment, the homology is from about 70% to about 80%. In another embodiment, the homology is from about 80% to about 85%. In another embodiment, the homology is from about 85% to about 90%. In another embodiment, the homology is about 90%, about 91%, about 92%, about 93%, about 94%, about 95%, about 96%, about 97%, about 98%, about 99%, or 100%.

Modifications

According to the invention, oligonucleotide compounds can comprise at least one region where the oligonucleotide is modified in order to exhibit one or more desired properties. The desired properties of the oligonucleotide include, but are not limited, for example, to increased resistance to nuclease degradation, increased cellular uptake, and/or increased binding affinity for the target nucleic acid. Modified oligonucleotides can include, for example, synthetic nucleotides having modified base moieties and/or modified sugar moieties (see e.g., described generally by Schcit, *Nucleotide Analogs*, John Wiley, New York, 1980; Freier & Altmann, (1997) *Nucl. Acid. Res.*, 25(22), 4429-4443, Toulme, J. J., (2001) *Nature Biotechnology* 19:17-18; Manoharan M., (1999) *Biochemica et Biophysica Acta* 1489:117-139; Freier S. M., (1997) *Nucleic Acid Research*, 25:4429-4443, Uhlman, E., (2000) *Drug Discovery & Development*, 3: 203-213, Herdewin P., (2000) *Antisense & Nucleic Acid Drug Dev.*, 10:297-310); or 2'-O, 3'-C-linked [3.2.0]bicycloarabinonucleosides. Such modified nucleotides include synthetic nucleotides designed to enhance binding properties, e.g., duplex or triplex stability, specificity, or the like.

An oligonucleotide compound, whether DNA, RNA, DNA or RNA with modified nucleotides, DNA or RNA with substituted nucleotides, and the like, can specifically hybridize when binding of the oligonucleotide compound to the target nucleic acid (e.g., a DNA or RNA molecule) interferes with the normal function of the target DNA or RNA. Further modifications can include conjugate groups attached to one of the termini of an oligonucleotide compound or to selected nucleotide positions of an oligonucleotide compound, conjugate group(s) added to various positions on the sugar ring, or conjugate group(s) added to one of the internucleotide linkages. In one embodiment, the interference can cause a loss of utility, and there is a sufficient degree of complementarity to avoid non-specific binding of the oligonucleotide compound to non-target nucleic acid sequences under conditions in which specific binding is desired. Conditions in which specific binding are desired include, but are not limited to, physiological conditions in in vivo assays or in therapeutic treatment, or conditions in which the in vitro assays are performed.

ASOs comprise a more general grouping of antisense compounds, which include but are not limited to siRNA, ribozymes, external guide sequence (EGS) oligonucleotides, single- or double-stranded RNA interference (RNAi), and other oligonucleotides that hybridize to at least a portion of the target nucleic acid sequences and modulate its function. The antisense compounds can be single-stranded, double-stranded, circular or hairpin and can comprise structural elements such as mismatches or loops. Antisense compounds are routinely prepared linearly but one of ordinary skill in the art can prepare antisense compounds to be joined or otherwise prepared to be circular and/or branched.

In one embodiment, oligonucleotide compounds directed to a nucleic acid sequence of a subunit of the MMR system (such as MSH2, MSH3, MSH6, MLH1, MLH3, PMS1, or PMS2) can comprise one or more modified nucleotides. In one embodiment, oligonucleotide compounds directed to a nucleic acid sequence of a subunit of the MMR system (such as MSH2, MSH3, MSH6, MLH1, MLH3, PMS1, or PMS2) can comprise shorter or longer fragment lengths (e.g., 15-, 16-, 17-, 18-, 19-20-, 21-, 22-, 23-, 24-, 25-, 26-, 27-, 28-, 29-, 30-, 31-, 32-, 33-, 34-, 35-, 36-, 37-, 38-, 39-, 40-, 41-, 42-, 43-, 44-, 45-, 46-, 47-, 48-, 49-, or 50-mers). In one embodiment, oligonucleotide compounds directed to a nucleic acid sequence of a subunit of the MMR system (such as MSH2, MSH3, MSH6, MLH1, MLH3, PMS1, or PMS2) can comprise modified bonds or internucleotide linkages. Non-limiting examples of modified bonds or internucleotide linkages include phosphorothioate, phosphorodithioate, and the like. In one embodiment, the oligonucleotide compounds can comprise a phosphorus derivative. In one embodiment, the phosphorus derivative (or modified phosphate group) can be attached to the sugar or sugar analog moiety in the modified oligonucleotides of the present invention. Non-limiting examples of a phosphorus derivative (or a modified phosphate group) include a monophosphate, diphosphate, triphosphate, alkylphosphate, alkanephosphate, phosphorothioate and the like. The preparation of the exemplary phosphorus derivatives (or modified phosphate groups), and their incorporation into nucleotides (e.g., those comprising an oligonucleotide compound of the invention), is well-known in the art.

A number of nucleotide modifications have been shown to make the oligonucleotide into which they are incorporated more resistant to nuclease digestion than the native oligodeoxynucleotide. Oligonucleotides that have been modified to enhance their nuclease resistance survive intact for a longer time than unmodified oligonucleotides. As discussed herein, embodiments of the present invention encompass modified oligonucleotides, such as modified ASOs directed to a nucleic acid sequence of a subunit of the MMR system (such as MSH2, MSH3, MSH6, MLH1, MLH3, PMS1, or PMS2). Modified oligonucleotides can comprise 2'-O-methyl modified oligoribonucleotides, which render the antisense oligonucleotide resistant to RNase H degradation. In one embodiment, modified oligonucleotides comprise a phosphorothioate backbone. For example, the phosphorothioate backbone increases the stability of an oligonucleotide compound against nucleases and enhances cellular uptake. In some embodiments, oligonucleotide compounds can comprise a full length phosphorodiamidate DNA. In some embodiments, oligonucleotide compounds can comprise one or nucleotides having a 2'O-methyl modification. In some embodiments, oligonucleotide compounds comprise one or more modifications discussed herein. Non-limiting examples of modified backbones include phosphorothioates, phosphinates, phosphorodithioates, phosphoramidates, phosphotriesters, aminoalkylphosphotriesters, methyl and other alkyl phosphonates (e.g., phosphonates comprising 3' alkylene phosphonates), short chain alkyl or cycloalkyl intersugar linkages or short chain heteroatomic or heterocyclic intersugar linkages. In one embodiment, oligonucleotide compounds directed to a nucleic acid sequence of a subunit of the MMR system (such as MSH2, MSH3, MSH6, MLH1, MLH3, PMS1, or PMS2) comprise phosphorothioate backbones.

In one embodiment, the region of a modified oligonucleotide compound directed to a nucleic acid sequence of a subunit of the MMR system (such as MSH2, MSH3, MSH6, MLH1, MLH3, PMS1, or PMS2) comprises at least one nucleotide modified at the 2' position of the sugar. In some embodiments, the nucleotide having a modification at the 2' position of the sugar comprises a 2'-O-alkyl, 2'-O-alkyl-O-alkyl, or 2'-fluoro-modified nucleotide. In some embodiments, RNA modifications include 2'-fluoro, 2'-amino and 2'-O-methyl modifications on the ribose of pyrimidines.

As discussed herein, oligonucleotide compounds can comprise additional modifications such as morpholino phosphorodiamidate DNA, locked nucleic acids (LNA), and ethylene bridged nucleic acids. These modifications can render the oligonucleotide compounds RNase H and nuclease resistant as well as can increase the affinity for the target RNA. In one embodiment, oligonucleotide compositions of the invention have morpholino backbone structures (e.g., as disclosed by Summerton and Weller, in U.S. Pat. No. 5,034,506, which is hereby incorporated by reference in its entirety). Morpholinos, for example, are commercially available through Gene Tools, LLC, Philomath Oreg.; http://www.gene-tools.com/).

For example, the morpholino backbone of oligonucleotide analogues makes them resistant to nucleases and proteases so that they are long-lived in the cell. Some morpholino oligomers can be diluted by cell division and gradually become ineffective after a single dose in rapidly dividing tissues or in growing organisms. In contrast, morpholino splice switching oligonucleotides (SSOs) remain active in post-mitotic tissues such as brain and spinal cord for several months (A2). In one embodiment, the region of a modified oligonucleotide compound directed to a nucleic acid sequence of a subunit of the MMR system (such as MSH2, MSH3, MSH6, MLH1, MLH3, PMS1, or PMS2) comprises at least one nucleotide modified with a morpholino subunit.

A number of nucleotide modifications incorporated into an oligonucleotide (e.g., resulting in an oligonucleotide analog), makes the oligonucleotide useful for steric blocking applications, such as exon skipping. For example, negatively charged oligonucleotide analogues, such as oligodeoxynucleotide phosphorothioate (DNA-PS), 2'-O-methylphosphorothioate (OMe-PS), 2'-O-methoxyethyl (MOE), 2'-deoxy-2'-fluoronucleotides (2'-F), locked nucleic acids (LNA; also referred to as bridged nucleic acids (BNA)), ethylene-bridged nucleic acids (ENA), tricycloDNA analogue (TcDNA), and 2'-O-[2-(N-methylcarbamoyl)ethyl]uridine (MCE), as disclosed in Järver et al. (2014) Nuc. Acid Therap., 24(1):37-47 (incorporated by reference in its entirety), can be used to induce exon skipping:

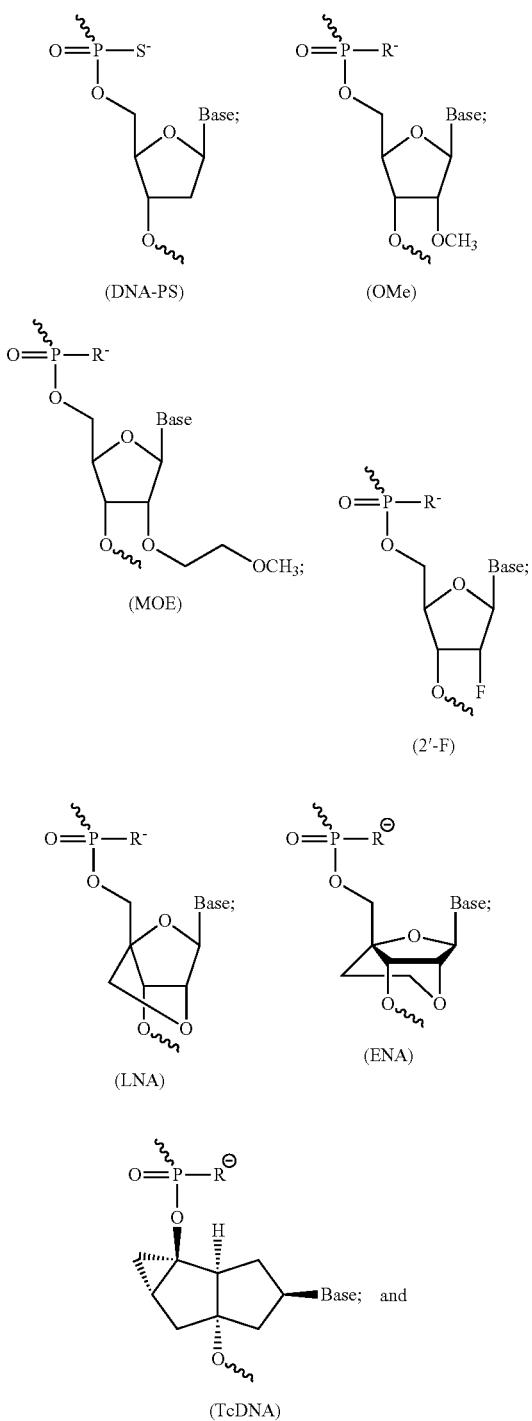

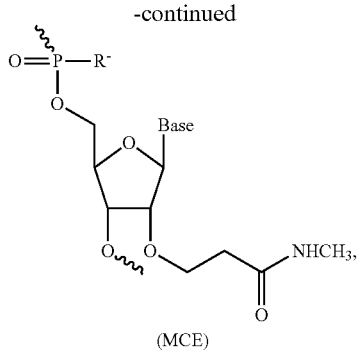

(MCE)

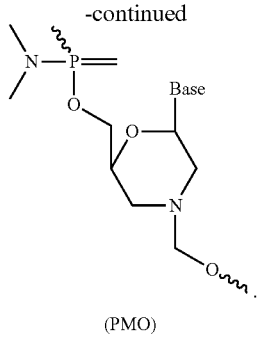

(PMO)

where R can be O or S in the above-listed negatively charged oligonucleotide analogues. In one embodiment, the oligonucleotide compounds disclosed herein, such as for example, nucleic acid molecules set forth in SEQ ID NOS: 3 and 4, comprise one or more substitutions or modifications. In one embodiment, the oligonucleotide compounds disclosed herein, such as for example, nucleic acid molecules set forth in Table 4, comprise one or more substitutions or modifications. In one embodiment, the oligonucleotide compounds are substituted with at least one locked nucleic acid (LNA). In one embodiment, the oligonucleotide compounds are substituted with at least one phosphorothioate (PS). In one embodiment, the oligonucleotide compounds are substituted with at least one 2'-O-methylphosphorothioate (OMe-PS). In one embodiment, the oligonucleotide compounds are substituted with at least one 2'-O-methoxyethyl (MOE). In one embodiment, the oligonucleotide compounds are substituted with at least one 2'-deoxy-2'-fluoronucleotide (2'-F). In one embodiment, the oligonucleotide compounds are substituted with at least one ethylene-bridged nucleic acid (ENA). In one embodiment, the oligonucleotide compounds are substituted with at least one tricycloDNA analogue (TcDNA). In one embodiment, the oligonucleotide compounds are substituted with at least one 2'-O-[2-(N-methylcarbamoyl)ethyl]uridine (MCE). In one embodiment, the oligonucleotide compounds are substituted with at least one oligodeoxynucleotide phosphorothioate (DNA-PS), 2'-O-methylphosphorothioate (OMe-PS), 2'-O-methoxyethyl (MOE), 2'-deoxy-2'-fluoronucleotide (2'-F), locked nucleic acid (LNA), ethylene-bridged nucleic acid (ENA), tricycloDNA analogue (TcDNA), 2'-O-[2-(N-methylcarbamoyl)ethyl]uridine (MCE), or a combination thereof.

Charge-neutral peptide nucleic acids (PNA) and phosphorodiamidate morpholino oligonucleotides (PMO) are further examples of oligonucleotide analogues, as disclosed in Järver et al. (2014) *Nuc. Acid Therap.,* 24(1):37-47 (incorporated by reference in its entirety), that can be used to induce exon skipping:

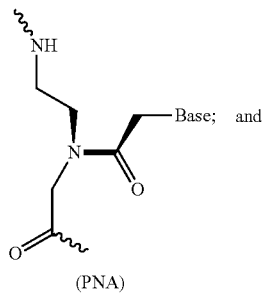

(PNA)

In one embodiment, the oligonucleotide compounds disclosed herein, such as for example, nucleic acid molecules set forth in SEQ ID NOS: 3 and 4, comprise one or more substitutions or modifications. In one embodiment, the oligonucleotide compounds disclosed herein, such as for example, nucleic acid molecules set forth in Table 4, comprise one or more substitutions or modifications. In one embodiment, the oligonucleotide compounds are substituted with at least one peptide nucleic acid (PNA). In one embodiment, the oligonucleotide compounds are substituted with at least one phosphorothioate (PS). In one embodiment, the oligonucleotide compounds are substituted with at least one peptide nucleic acid (PNA), phosphorothioate (PS), or a combination thereof.

Due to the uncharged backbone of the morpholino subunit, these oligonucleotide analogues can bind their complementary target RNA very tightly (A1). Morpholinos work simply by binding their complementary sequence and excluding binding by proteins or nucleic acids. In one embodiment, binding to a splice donor or acceptor sequence can interfere with recognition of those sequences by the splicing machinery and cause exon skipping. Morpholinos have most often been used for protein knockdown experiments. A morpholino designed to bind the initiating AUG in an mRNA will block translation initiation by ribosomes. An advantage of morpholinos is the predictable way that they work in different species and different tissues since they are not dependent on accessory protein expression such as RISC, dicer, or RNaseH for activity.

In one embodiment, oligonucleotide compounds disclosed herein can bind to a selected target nucleic acid sequence to induce exon skipping. In some embodiments, masking a donor splice site can induce exon skipping. In some embodiments, masking an acceptor splice site can induce exon skipping. In one embodiment, an oligonucleotide compound (e.g., an SSO) can cause an intron to be retained; thus, when an intron is retained, for example, the mRNA is de-stabilized and subsequently degraded, wherein intron retention mediated by an oligonucleotide compound, such as an SSO, can lower expression of the target gene. In one embodiment, the oligonucleotide compound is a modified oligonucleotide directed to a target nucleic acid sequence of a subunit of the MMR system (such as MSH2, MSH3, MSH6, MLH1, MLH3, PMS1, or PMS2). In another embodiment, the modified oligonucleotide compound directed to a target nucleic acid sequence of a subunit of the MMR system comprises at least one morpholino subunit. For example, to induce exon skipping in exons of the MLH3 gene transcript, the antisense molecules are selected from the group of SSOs shown in Table 4.

TABLE 4

SSOs for human MLH3 exons 2 through 12.

| SEQ ID NO: | SSO | SEQUENCE |
|---|---|---|
| 7 | hMLH3X2ac | TCTCTGACTGGAAATAATTGCctat |
| 8 | hMLH3X2dn | ATTCTCAAGTACAACATCCACAGCC |
| 9 | hMLH3X3ac | TGACACCTGTACTGAGACCctaaat |
| 10 | hMLH3X3dn | tctctgccacccttacCTCTGTTAT |
| 11 | hMLH3X4ac | CATCCACAGTATctagggcaaaagg |
| 12 | hMLH3X4dn | ccacCTCTGGATAACGGGCAAATAC |
| 13 | hMLH3X5ac | CAGCAACCtagaaagactcagcaaa |
| 14 | hMLH3X5dn | gttaatcttttacCTGCATTGAATG |
| 15 | hMLH3X6ac | TGCTGGAGAACctgtcagacattca |
| 16 | hMLH3X6dn | actccattcttacCTGCCTCGCCAT |
| 17 | hMLH3X7ac | GTTCCCACctagatgagcaaggatt |
| 18 | hMLH3X7dn | tgcaaacagatccttacCAATGATA |
| 19 | hMLH3X8ac | GAATctattggcagaaagatgaatg |
| 20 | hMLH3X8dn | acattctcatggtggtactgacCAT |
| 21 | hMLH3X9ac | GTAACACctaaagagataacctcaa |
| 22 | hMLH3X9dn | taacatctgcagctgtgtcttacCT |
| 23 | hMLH3X10ac | Cctgcaaagcaaaaggaaaatcggc |
| 24 | hMLH3X10dn | tacCTCCAGTTGTTCTCGGATAAAT |
| 25 | hMLH3X11ac | CGGTGGTCTGGAGTAGctaatgcat |
| 26 | hMLH3X11dn | ctatgttgaagggcttacCATGGCA |
| 27 | hMLH3X12ac | AATGGCCCctaaatgaaagacagaa |
| 28 | hMLH3X12dn | tgctcctgttagtcattaatgtacC |

In one embodiment, an oligonucleotide compound directed to a nucleic acid sequence of a subunit of the MMR system comprises SEQ ID NO: 3. In one embodiment, an oligonucleotide compound directed to a nucleic acid sequence of a subunit of the MMR system comprises SEQ ID NO: 4. In one embodiment, an oligonucleotide compound directed to a nucleic acid sequence of a subunit of the MMR system comprises a nucleic acid sequence depicted in Table 4. In one embodiment, an oligonucleotide compound is directed to a nucleic acid sequence (or target complementary nucleic acid sequence) corresponding to a region of interest for any one of the exons 1-16 described herein for GenBank Accession No. NG_007110.2, or to an intron-exon junction, or to an exon-intron junction listed with GenBank Accession No. NG_007110.2. In one embodiment, an oligonucleotide compound is directed to a nucleic acid sequence (or target complementary nucleic acid sequence) corresponding to a region of interest for any one of the exons 1-24 described herein for GenBank Accession No. NG_016607.1, or to an intron-exon junction, or to an exon-intron junction listed with GenBank Accession No. NG_016607.1. In one embodiment, an oligonucleotide compound is directed to a nucleic acid sequence (or target complementary nucleic acid sequence) corresponding to a region of interest for any one of the exons 1-10 described herein for GenBank Accession No. NG_007111.1 or SEQ ID NO: 33, or to an intron-exon junction, or to an exon-intron junction listed with GenBank Accession No. NG_007111.1 or SEQ ID NO: 33. In one embodiment, an oligonucleotide compound is directed to a nucleic acid sequence (or target complementary nucleic acid sequence) corresponding to a region of interest for any one of the exons 1-19 described herein for GenBank Accession No. NG_007109.2, or to an intron-exon junction, or to an exon-intron junction listed with GenBank Accession No. NG_007109.2. In one embodiment, an oligonucleotide compound is directed to a nucleic acid sequence (or target complementary nucleic acid sequence) corresponding to a region of interest for any one of the exons 1-13 described herein for GenBank Accession No. NG_008648.1, or to an intron-exon junction, or to an exon-intron junction listed with GenBank Accession No. NG_008648.1. In one embodiment, an oligonucleotide compound is directed to a nucleic acid sequence (or target complementary nucleic acid sequence) corresponding to a region of interest for any one of the exons 1-13 described herein for GenBank Accession No. NG_008649.1 or SEQ ID NO: 1, or to an intron-exon junction, or to an exon-intron junction listed with GenBank Accession No. NG_008649.1 or SEQ ID NO: 1. In one embodiment, an oligonucleotide compound is directed to a nucleic acid sequence (or target complementary nucleic acid sequence) corresponding to a region of interest for any one of the exons 1-15 described herein for GenBank Accession No. NG_008466.1, or to an intron-exon junction, or to an exon-intron junction listed with GenBank Accession No. NG_008466.1.

In some embodiments, an oligonucleotide compound directed to a nucleic acid sequence of a subunit of the MMR system is a modified oligonucleotide. According to the invention, a combination or "cocktail" of two or more oligonucleotide compounds can be provided that bind to a selected target nucleic acid (such as a subunit of the MMR system) in order to induce exon skipping. For example, to induce exon skipping in exons of a subunit of the MMR system gene transcript (such as MSH2, MSH3, MSH6, MLH1, MLH3, PMS1, or PMS2), the oligonucleotide compounds in the cocktail are selected from the group of SSOs shown in Table 4. In one embodiment, the cocktail comprises at least 2 SSOs selected from Table 4. In one embodiment, the cocktail comprises SSOs comprising SEQ ID NO: 3 and SEQ ID NO: 4. In one embodiment, the cocktail comprises SSOs comprising SEQ ID NO: 3 and an SSO selected from the group of SSOs shown in Table 4. In one embodiment, the cocktail comprises SSOs comprising SEQ ID NO: 4 and an SSO selected from the group of SSOs shown in Table 4. In one embodiment, the cocktail comprises SSOs directed to nucleic acid sequences (or target complementary nucleic acid sequences) corresponding to a region of interest for any one of the exons 1-16 described herein for GenBank Accession No. NG_007110.2, or to an intron-exon junction, or to an exon-intron junction listed with GenBank Accession No. NG_007110.2. In one embodiment, the cocktail comprises SSOs directed to nucleic acid sequences (or target complementary nucleic acid sequences) corresponding to a region of interest for any one of the exons 1-24 described herein for GenBank Accession No. NG_016607.1, or to an intron-exon junction, or to an exon-intron junction listed with GenBank Accession No. NG_016607.1. In one embodiment, the cocktail comprises SSOs directed to nucleic acid sequences (or target complementary nucleic acid sequences) corresponding to a region of interest for any one of the exons 1-10 described herein for GenBank Accession No. NG_007111.1 or SEQ ID NO: 33, or to an intron-exon junction, or to an exon-intron junction listed with GenBank Accession No. NG_007111.1 or SEQ ID NO: 33. In one embodiment, the cocktail comprises SSOs directed to nucleic acid sequences (or target complementary nucleic acid sequences) corresponding to a region of interest for any one of the exons 1-19 described herein for GenBank Accession No. NG_007109.2, or to an intron-exon junction, or to an exon-intron junction listed with GenBank Accession No. NG_007109.2. In one embodiment, the cocktail comprises SSOs directed to nucleic acid sequences (or target complementary nucleic acid sequences) corresponding to a region of interest for any one of the exons 1-13 described herein for GenBank Accession No. NG_008648.1, or to an intron-exon junction, or to an exon-intron junction listed with GenBank Accession No. NG_008648.1. In one embodiment, the cocktail comprises SSOs directed to nucleic acid sequences (or target complementary nucleic acid sequences) corresponding to a region of interest for any one of the exons 1-13 described herein for GenBank Accession No. NG_008649.1 or SEQ ID NO: 1, or to an intron-exon junction, or to an exon-intron junction listed with GenBank Accession No. NG_008649.1 or SEQ ID NO: 1. In one embodiment, the cocktail comprises SSOs directed to nucleic acid sequences (or target complementary nucleic acid sequences) corresponding to a region of interest for any one of the exons 1-15 described herein for GenBank Accession No. NG_008466.1, or to an intron-exon junction, or to an exon-intron junction listed with GenBank Accession No. NG_008466.1

Target site(s) useful in the practice of the invention are those involved in mRNA splicing (such as splice donor sites, splice acceptor sites or exonic splicing enhancer elements). Splicing branch points and exon recognition sequences or splice enhancers are also potential target sites for modulation of mRNA splicing. In one embodiment, oligonucleotide compounds disclosed herein can bind to a selected target nucleic acid sequence to induce exon skipping. In some embodiments, masking a donor splice site can induce exon skipping. In some embodiments, masking an acceptor splice site can induce exon skipping. For example, owing to the nature of morpholino oligomers, one of ordinary skill in the art can identify sequences that will reliably bind splice junctions. As described in the examples herein, the efficacy of targeted morpholino SSOs can be quickly ascertained in tissue culture.

Another modification of the oligonucleotide compounds disclosed herein involves chemically linking one or more moieties or conjugates to the oligonucleotide, which enhance the activity, cellular distribution, or cellular uptake of the oligonucleotide. These moieties or conjugates can include conjugate groups covalently bound to functional groups such as primary or secondary hydroxyl groups. Non-limiting examples of moieties and conjugates include lipid moieties (such as a cholesterol moiety, a cholesteryl moiety, a thiocholesterol moeity), intercalators, reporter molecules, a palmityl moiety, or an octadecylamine or hexylamino-carbonyl-oxycholesterol moiety, a phospholipid, aliphatic chains (such as dodecandiol or undecyl residues), polyamine chains, polyamide chains, polyethylene glycol chains, polyether chains, cholic acid, and adamantane acetic acid. Examples of conjugate groups include, but are not limited to, cholesterols, lipids, phospholipids, biotin, phenazine, folate, phenanthridine, anthraquinone, acridine, fluoresceins, rhodamines, coumarins, and dyes.

Oligonucleotide compounds comprising lipophilic moieties, and methods for preparing such are known in the art, for example, as described in U.S. Pat. Nos. 5,138,045, 5,218,105 and 5,459,255, each of which is incorporated by reference in its entirety.

Representative United States patents that teach the preparation of oligonucleotide compound conjugates include, but are not limited to, U.S. Pat. Nos. 4,828,979; 4,948,882; 5,218,105; 5,525,465; 5,541,313; 5,545,730; 5,552, 538; 5,578,717; 5,580,731; 5,580,731; 5,591,584; 5,109,124; 5,118,802; 5,138,045; 5,414,077; 5,486, 603; 5,512,439; 5,578,718; 5,608,046; 4,587,044; 4,605,735; 4,667,025; 4,762, 779; 4,789,737; 4,824,941; 4,835,263; 4,876,335; 4,904,582; 4,958,013; 5,082, 830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241; 5,391, 723; 5,416,203; 5,451,463; 5,510,475; 5,512,667; 5,514,785; 5,565,552; 5,567,810; 5,574,142; 5,585,481; 5,587,371; 5,595,726; 5,597,696; 5,599,923; 5,599, 928 and 5,688,941, each of which is hereby incorporated by reference in its entirety. Representative conjugate groups are disclosed in U.S. Pat. Nos. 5,578,718; 6,153,737; 6,287,860; and 6,783,931, each of which are incorporated by reference in its entirety.

The oligonucleotide compounds can be conveniently and routinely made through the established technique of solid phase synthesis. Equipment useful for such syntheses can be obtained through several commercial vendors, including Applied Biosystems (Foster City, Calif.). Synthesis of the oligonucleotide compounds is well understood by one of ordinary skill in the art. It is also well known in the art to use similar techniques to prepare other oligonucleotides such as the phosphorothioates and alkylated derivatives. It is also well known to use similar techniques and commercially available modified amidites and controlled-pore glass (CPG) products such as biotin, fluorescein, acridine or psoralen-modified amidites and/or CPG (available from Glen Research, Sterling Va.) to synthesize fluorescently labeled, biotinylated or other modified oligonucleotides such as cholesterol-modified oligonucleotides. Morpholinos, for example, are commercially available through Gene Tools, LLC, Philomath Oreg.; http://www.gene-tools.com/). For example, the oligonucleotide compounds of the invention (such as ASOs and SSOs) are synthesized in vitro and do not include antisense compositions of biological origin, or genetic vector constructs designed to direct the in vivo synthesis of oligonucleotide compounds.

In one embodiment, the oligonucleotide compounds (e.g., modified oligonucleotide compounds) bind to coding and/or non-coding regions of a target nucleic acid sequence of a subunit of the MMR system (such as MSH2, MSH3, MSH6, MLH1, MLH3, PMS1, or PMS2), and modulate the expression and/or function of the target molecule. In one embodiment, the oligonucleotide compounds (e.g., modified oligonucleotide compounds) bind to a natural antisense target nucleic acid sequence of a subunit of the MMR system (such as MSH2, MSH3, MSH6, MLH1, MLH3, PMS1, or PMS2), and modulate the expression and/or function of the target molecule. In one embodiment, the oligonucleotide compounds bind to a sense target nucleic acid sequence of a subunit of the MMR system (such as MSH2, MSH3, MSH6, MLH1, MLH3, PMS1, or PMS2), and modulate the expression and/or function of the target molecule.

Embodiments of the present invention are directed to oligonucleotide compounds that hybridize with a complementary sequence of the human MSH2 gene and/or mRNA. For example, mRNA may be pre-mRNA. The human MSH2 gene comprises SEQ ID NO: 35. Embodiments of the present invention can be directed to modifying MSH2 gene expression. For example, embodiments of the present invention may be directed at skipping MSH2 exons. Embodiments of the present invention encompass splice switching oligonucleotides (SSOs). In one embodiment, the oligonucleotide compound comprises at least one modification described herein. Embodiments of the present invention encompass morpholino oligonucleotides complementary to the target nucleic acid sequence of MSH2.

Embodiments of the present invention are directed to oligonucleotide compounds that hybridize with a complementary sequence of the human MSH3 gene and/or mRNA. For example, mRNA may be pre-mRNA. The human MSH3 gene comprises SEQ ID NO: 36. Embodiments of the present invention can be directed to modifying MSH3 gene expression. For example, embodiments of the present invention may be directed at skipping MSH3 exons. Embodiments of the present invention encompass splice switching oligonucleotides (SSOs). In one embodiment, the oligonucleotide compound comprises at least one modification described herein. Embodiments of the present invention encompass morpholino oligonucleotides complementary to the target nucleic acid sequence of MSH3.

Embodiments of the present invention are directed to oligonucleotide compounds that hybridize with a complementary sequence of the human MSH6 gene and/or mRNA. For example, mRNA may be pre-mRNA. The human MSH6 gene comprises SEQ ID NO: 37. Embodiments of the present invention can be directed to modifying MSH6 gene expression. For example, embodiments of the present invention may be directed at skipping MSH6 exons. Embodiments of the present invention encompass splice switching oligonucleotides (SSOs). In one embodiment, the oligonucleotide compound comprises at least one modification described herein. Embodiments of the present invention encompass morpholino oligonucleotides complementary to the target nucleic acid sequence of MSH6.

Embodiments of the present invention are directed to oligonucleotide compounds that hybridize with a complementary sequence of the human MLH1 gene and/or mRNA. For example, mRNA may be pre-mRNA. The human MLH1 gene comprises SEQ ID NO: 38. Embodiments of the present invention can be directed to modifying MLH1 gene expression. For example, embodiments of the present invention may be directed at skipping MLH1 exons. Embodiments of the present invention encompass splice switching oligonucleotides (SSOs). In one embodiment, the oligonucleotide compound comprises at least one modification described herein. Embodiments of the present invention encompass morpholino oligonucleotides complementary to the target nucleic acid sequence of MLH1.

Embodiments of the present invention are directed to oligonucleotide compounds that hybridize with a complementary sequence of the human PMS1 gene and/or mRNA. For example, mRNA may be pre-mRNA. The human PMS1 gene comprises SEQ ID NO: 39. Embodiments of the present invention can be directed to modifying PMS1 gene expression. For example, embodiments of the present invention may be directed at skipping PMS1 exons. Embodiments of the present invention encompass splice switching oligonucleotides (SSOs). In one embodiment, the oligonucleotide compound comprises at least one modification described herein. Embodiments of the present invention encompass morpholino oligonucleotides complementary to the target nucleic acid sequence of PMS1.

Embodiments of the present invention are directed to oligonucleotide compounds that hybridize with a complementary sequence of the human PMS2 gene and/or mRNA. For example, mRNA may be pre-mRNA. The human PMS2 gene comprises SEQ ID NO: 40. Embodiments of the present invention can be directed to modifying PMS2 gene expression. For example, embodiments of the present invention may be directed at skipping PMS2 exons. Embodiments of the present invention encompass splice switching oligonucleotides (SSOs). In one embodiment, the oligonucleotide compound comprises at least one modification described herein. Embodiments of the present invention encompass morpholino oligonucleotides complementary to the target nucleic acid sequence of PMS2.

Embodiments of the present invention encompass oligonucleotide compounds that hybridize with a complementary sequence of the human MLH3 gene and/or mRNA. For example, mRNA may be pre-mRNA. The human MLH3 gene comprises SEQ ID NO: 1. Embodiments of the present invention are directed to modifying MLH3 gene expression. For example, embodiments of the present invention may be directed at skipping of MLH3 exon 7 (SEQ ID NO: 2). Embodiments of the present invention encompass splice switching oligonucleotides (SSOs). Embodiments of the present invention include oligonucleotide compounds comprising SEQ ID NO: 3 or SEQ ID NO: 4. In one embodiment, the oligonucleotide compound comprises at least one modification described herein. Embodiments of the present invention encompass morpholino oligonucleotides complementary to the target nucleic acid sequence of MLH3.

Target nucleic acid sequences of about 5-100 nucleotides in length, comprising a stretch of at least five (5) consecutive are suitable for targeting. Target nucleic acid sequences can include DNA or RNA sequences that comprise at least 5 consecutive nucleotides from the 5'-terminus of the gene encoding a subunit of the MMR system (such as MSH2, MSH3, MSH6, MLH1, MLH3, PMS1, or PMS2). Target nucleic acid sequences can include DNA or RNA sequences that comprise at least 5 consecutive nucleotides from the 3'-terminus of the gene encoding a subunit of the MMR system (such as MSH2, MSH3, MSH6, MLH1, MLH3, PMS1, or PMS2).

In one embodiment, the oligonucleotide compound binds to an antisense strand of a particular target nucleic acid sequence (for example, a subunit of the MMR system (such as MSH2, MSH3, MSH6, MLH1, MLH3, PMS1, or PMS2)). The target nucleic acid sequences include coding as well as non-coding regions. Generally, the oligonucleotide compound can be from about 10 nucleotides in length up to about 50 nucleotides in length. In one embodiment, the oligonucleotide compounds of the invention are 10 to 50 nucleotides in length. In one embodiment, the oligonucleotide compounds are at least 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 nucleotides in length. In some embodiments, the oligonucleotides are 15 nucleotides in length. In some embodiments, the oligonucleotides are 20 nucleotides in length. In some embodiments, the oligonucleotides are 25 nucleotides in length. In some embodiments, the oligonucleotides are 20 nucleotides in length. In some embodiments, the oligonucleotides are 30 nucleotides in length.

Kits, Diagnostics, and Therapeutics.

The oligonucleotide compounds of the present invention can be utilized for diagnostics, therapeutics, and prophylaxis, and as components of kits. For example, the specificity and sensitivity of antisense oligonucleotides can be harnessed for therapeutic uses. Oligonucleotide compounds (such as antisense oligonucleotides disclosed herein) can be employed as therapeutic moieties in the treatment of disease states in subjects, such as human subjects. For example, oligonucleotide compounds can be useful therapeutics utilized in treatment regimens for treatment of cells, tissues and animals, especially humans.

Transfer of an exogenous nucleic acid into a host cell or organism, such as an oligonucleotide compound of the invention, can be assessed by directly detecting the presence of the nucleic acid in the cell or organism. Detection can be achieved using several methods well known and practiced in the art. For example, the presence of the exogenous nucleic acid can be detected by Southern blot or by a polymerase chain reaction (PCR) technique using primers that specifically amplify nucleotide sequences associated with the nucleic acid. Expression of the exogenous nucleic acids can also be measured using conventional methods including gene expression analysis. For instance, mRNA produced from an exogenous nucleic acid (or its absence thereof) can be detected and quantified using a Northern blot and reverse transcription PCR (RT-PCR).

Kits.

For use in kits and diagnostics and in various biological systems, the oligonucleotide compounds of the present invention, either alone or in combination with other compounds or therapeutics, are useful as tools in differential and/or combinatorial analyses to elucidate expression patterns of a portion or the entire complement of genes expressed within cells and tissues, such as a subunit of the MMR system (e.g., MSH2, MSH3, MSH6, MLH1, MLH3, PMS1, or PMS2).

The invention also provides kits for treatment of a subject with a genetic disease, wherein the kit comprises at least an oligonucleotide compound, packaged in a suitable container, together with instructions for its use. In one embodiment, the invention provides for a kit for the treatment of a DNA Repeat Expansion Disease (DRED), the kit comprising an oligonucleotide compound discussed herein. In one embodiment, the invention provides for a kit for the treatment of a DNA Repeat Expansion Disease (DRED), the kit comprising at least two oligonucleotide compounds discussed herein. In one embodiment, the DRED is any one listed in Table 1. In one embodiment, the oligonucleotide compound comprises SEQ ID NO: 3 or SEQ ID NO: 4. In one embodiment, the oligonucleotide compound comprises a nucleic acid sequence depicted in Table 4. In one embodiment, the oligonucleotide compound comprises at least one modification described herein. In some embodiments, the kits will contain at least one oligonucleotide compound (e.g., an ASO or SSO), such as shown in Table 4, SEQ ID NO: 3 or SEQ ID NO: 4, or a cocktail of antisense molecules comprising a combination of SEQ ID NO: 3, SEQ ID NO:4, or a nucleic acid sequence depicted in Table 4. The kits can also comprise any one, or a combination thereof, of the following: an oligonucleotide compound that is directed to a nucleic acid sequence (or target complementary nucleic acid sequence) corresponding to a region of interest for any one of the exons 1-16 described herein for GenBank Accession No. NG_007110.2, or to an intron-exon junction, or to an exon-intron junction listed with GenBank Accession No. NG_007110.2; an oligonucleotide compound that is directed to a nucleic acid sequence (or target complementary nucleic acid sequence) corresponding to a region of interest for any one of the exons 1-24 described herein for GenBank Accession No. NG_016607.1, or to an intron-exon junction, or to an exon-intron junction listed with GenBank Accession No. NG_016607.1; an oligonucleotide compound that is directed to a nucleic acid sequence (or target complementary nucleic acid sequence) corresponding to a region of interest for any one of the exons 1-10 described herein for GenBank Accession No. NG_007111.1 or SEQ ID NO: 33, or to an intron-exon junction, or to an exon-intron junction listed with GenBank Accession No. NG_007111.1 or SEQ ID NO: 33; an oligonucleotide compound that is directed to a nucleic acid sequence (or target complementary nucleic acid sequence) corresponding to a region of interest for any one of the exons 1-19 described herein for GenBank Accession No. NG_007109.2, or to an intron-exon junction, or to an exon-intron junction listed with GenBank Accession No. NG_007109.2; an oligonucleotide compound that is directed to a nucleic acid sequence (or target complementary nucleic acid sequence) corresponding to a region of interest for any one of the exons 1-13 described herein for GenBank Accession No. NG_008648.1, or to an intron-exon junction, or to an exon-intron junction listed with GenBank Accession No. NG_008648.1; an oligonucleotide compound that is directed to a nucleic acid sequence (or target complementary nucleic acid sequence) corresponding to a region of interest for any one of the exons 1-13 described herein for GenBank Accession No. NG_008649.1 or SEQ ID NO: 1, or to an intron-exon junction, or to an exon-intron junction listed with GenBank Accession No. NG_008649.1 or SEQ ID NO: 1; or an oligonucleotide compound that is directed to a nucleic acid sequence (or target complementary nucleic acid sequence) corresponding to a region of interest for any one of the exons 1-15 described herein for GenBank Accession No. NG_008466.1, or to an intron-exon junction, or to an exon-intron junction listed with GenBank Accession No. NG_008466.1. The kits may also contain peripheral reagents such as buffers, stabilizers, and the like.

The invention provides kits for monitoring the efficacy of treatment in a subject with a genetic disease, wherein the kit comprises at least one primer, packaged in a suitable container, together with instructions for its use. In one embodiment, the kit comprises at least two primers. In one embodiment, the genetic disease is a DNA repeat expansion disease (DRED) listed in Table 1. In one embodiment, the status of a subunit of the MMR system (e.g., MSH2, MSH3, MSH6, MLH1, MLH3, PMS1, or PMS2) can be monitored. In one embodiment, the primer comprises MLH3 L3324 (TCCTTTCCTTCCGAGAGCTC, SEQ ID NO: 5). In one embodiment, the primer comprises MLH3×7L3138 (GCATTTCGATGTAGCCCTGG, SEQ ID NO: 29). In one embodiment, the primer comprises MLH3×7L3449 (TTGCCCGTTATCCAGAGGTT, SEQ ID NO: 30). In one embodiment, the primer comprises MLH3 R3757 (TTTTCCGACCAGAGCCTTGT, SEQ ID NO: 6). In one embodiment, the primer comprises MLH3×7R3862 (CAAGGCCCAGATCTTCCAGA, SEQ ID NO: 31). In one embodiment, the primer comprises MLH3×7R4013 (AGCTCCAGTTGTTCTCGGAT, SEQ ID NO: 32). The kits may also contain peripheral reagents such as buffers, stabilizers, and the like.

The invention provides kits for monitoring the progression of a DNA repeat expansion disease (DRED), wherein the kit comprises at least one primer, packaged in a suitable container, together with instructions for its use. In one embodiment, the kit comprises at least two primers. In one embodiment, the DRED is selected from the list in Table 1. In one embodiment, the DRED is Fredreich Ataxia. In one embodiment, the status of a subunit of the MMR system (e.g., MSH2, MSH3, MSH6, MLH1, MLH3, PMS1, or PMS2) can be monitored, indicative of the progression of a repeat expansion. In one embodiment, the MMR subunit is MLH3. In one embodiment, the primer comprises MLH3 L3324 (TCCTTTCCTTCCGAGAGCTC, SEQ ID NO: 5).

In one embodiment, the primer comprises MLH3×7L3138 (GCATTTCGATGTAGCCCTGG, SEQ ID NO: 29). In one embodiment, the primer comprises MLH3×7L3449 (TTGCCCGTTATCCAGAGGTT, SEQ ID NO: 30). In one embodiment, the primer comprises MLH3 R3757 (TTTTCCGACCAGAGCCTTGT, SEQ ID NO: 6). In one embodiment, the primer comprises MLH3×7R3862 (CAAGGCCCAGATCTTCCAGA, SEQ ID NO: 31). In one embodiment, the primer comprises MLH3×7R4013 (AGCTCCAGTTGTTCTCGGAT, SEQ ID NO: 32). The kits may also contain peripheral reagents such as buffers, stabilizers, and the like.

Treatments and Therapy for Diseases. As used herein and as is well understood in the art, "treatment" is an approach for obtaining beneficial or desired results, including clinical results. Beneficial or desired clinical results can include, but are not limited to, alleviation or amelioration of one or more symptoms or conditions, diminution of extent of disease, a stabilized (i.e., not worsening) state of disease, preventing spread of disease, delay or slowing of disease progression, amelioration or palliation of the disease state and remission (whether partial or total), whether detectable or undetectable. "Treatment" can also refer to prolonging survival as compared to expected survival if not receiving treatment.

The term "in need thereof" refers to the need for symptomatic or asymptomatic relief from a condition such as, for example, a DRED, a cancer, a neurodegenerative disease, or a combination thereof. The subject in need thereof may or may not be undergoing treatment for conditions related to, for example, a DRED, a cancer, a neurodegenerative disease, or a combination thereof.

European patent application 13170245.8 claims an antisense oligonucleotide directed against exon 43 of the dystrophin pre-mRNA, which facilitates the exclusion of exon 43 from the final mRNA. U.S. Pat. No. 8,361,979 claims antisense oligonucleotides that may be used for the treatment of Duchenne Muscular Dystrophy. U.S. Pat. No. 8,455,634 claims an antisense molecule capable of binding to a selected target site to induce exon skipping in the dystrophin gene. U.S. Application Publication No. US 2014/0039037 discloses claims directed to antisense oligonucleotides that induce skipping of exonic sequences that comprises the trinucleotide repeat expansion. These disclosures use antisense oligonucleotides to target the diseased gene itself, rather than disease modifying genes, such as a subunit of the MMR system (e.g., MSH2, MSH3, MSH6, MLH1, MLH3, PMS1, or PMS2). A drawback of targeting the diseased gene itself is that the proposed therapeutic has limited effectiveness for only a single disorder. For many of the expansion disorders, such as FXS, DM1, DM2, and FRDA the repeat is in an intron, or in the first or last exon, which cannot be skipped. Presently, there is no cure for any of the DNA repeat expansion disorders. Furthermore, the treatment options for these devastating disorders are generally inadequate. In particular, there remains an urgent unmet need for new therapeutic compositions that prevent the unwanted, progressive trinucleotide repeat expansion associated with such disorders. The object of this present invention is to address this unmet need.

The present disclosure relates generally to small molecule therapeutics (e.g., oligonucleotide compounds, naked or modified) useful for the treatment of DNA repeat expansion diseases (DREDs). In one embodiment, an oligonucleotide compound (e.g., an antisense oligonucleotide) is administered to a subject to prevent or treat diseases or disorders associated with DNA repeat expansion. In one embodiment, an oligonucleotide compound is directed to a target nucleic acid sequence of a subunit of the MMR system (e.g., MSH2, MSH3, MSH6, MLH1, MLH3, PMS1, or PMS2). In one embodiment, an effective amount of the oligonucleotide compound is administered to the subject. In some embodiments, the oligonucleotide compound is a modified oligonucleotide that is nuclease-resistant. In some embodiments, the oligonucleotide compound comprises a pharmaceutical composition administered to a subject in a pharmaceutically acceptable carrier. In some embodiments, the oligonucleotide compound (e.g., an antisense oligonucleotide that directs exon skipping) can serve as a therapeutic method for the treatment of various DREDs.

Embodiments of the invention may be used to treat human DRED. In particular, embodiments of the present invention may be used to treat diseases associated with expanded DNA repeats. For example, expanded DNA repeat disorders may include trinucleotide repeat disorders. Examples of diseases which may benefit from embodiments of the present invention may include Friedreich ataxia, ALS, Huntington's disease, Fragile X syndrome, Myotonic dystrophy Types I and II, Spino Cerebellar Ataxias (SCAs). SCAs may include SCA1, SCA2, SCA3, SCA6, SCAT, SCAB, SCA10 and SCA17. Additional examples of diseases, which may benefit from embodiments of the present invention may include those disorders listed in Table 1. In one embodiment, the DRED is Duchenne Muscular Dystrophy, Fredreich Ataxia, or Huntington's disease. In some embodiments, the DRED is a disease selected from Table 1. Embodiments of the invention may slow the rate of or inhibit repeat expansion. Embodiments of the present invention may slow the rate of or inhibit the progression of repeat expansion disorders. Embodiments of the invention may slow the rate so as to inhibit the progression from an asymptomatic size to a disease causing size, thus preventing onset of an expansion disease.

For therapeutics, a subject, for example, a human, suspected of having a disease or disorder (such as a DRED), which can be treated by modulating the expression of a nucleic acid sequence of a subunit of the MMR system (e.g., MSH2, MSH3, MSH6, MLH1, MLH3, PMS1, or PMS2) is treated by administering an oligonucleotide compound (such as an ASO) in accordance with this invention. In one embodiment, a pharmaceutical composition comprising a an oligonucleotide compound disclosed herein, such as a nuclease-resistant oligonucleotide 15 to 30 nucleotide bases in length targeted to a complementary nucleic acid sequence of a gene or gene product encoding a MutS or MutL subunit, is administered to a subject. In one embodiment, the oligonucleotide hybridizes with and decreases the expression of the human MutS or MutL subunit (such as MSH2, MSH3, MSH6, MLH1, MLH3, PMS1, or PMS2) by about 10%, about 20%, about 30%, about 40%, about 50%, about 60%, about 70%, about 75%, about 80%, about 85%, about 90%, about 95%, about 97%, about 98%, about 99%, or 100%, as compared to a normal control. In one embodiment, the oligonucleotide compound comprises at least one modification. In one embodiment, the oligonucleotide is 17 to 28 nucleotide bases in length. In one embodiment, the oligonucleotide is 18 to 25 nucleotide bases in length. In one embodiment, the oligonucleotide is 19 to 23 nucleotide bases in length.

In one embodiment, a pharmaceutical composition that is an oligonucleotide compound comprising an oligonucleotide complex can be administered. In one embodiment, the complex comprises a first oligonucleotide and a second oligonucleotide, wherein the first oligonucleotide comprises a sequence complementary to an acceptor region of an exon of a gene encoding a MutS or MutL subunit, and wherein the nucleic acid sequence of the first oligonucleotide comprises a nuclease-resistant modification, and wherein the second oligonucleotide comprises a sequence complementary to a donor region of an exon of a gene encoding a MutS or MutL subunit, and wherein the nucleic acid sequence of the second oligonucleotide comprises a nuclease-resistant modification. In another embodiment, the complex comprises a first oligonucleotide and a second oligonucleotide, wherein the first oligonucleotide comprises a sequence complementary to an acceptor region of an exon of a gene encoding a MutS or MutL subunit, and wherein the nucleic acid sequence of the first oligonucleotide comprises a nuclease-resistant modification, and wherein the second oligonucleotide comprises a sequence complementary to a donor region of an exon of a gene encoding a MutS or MutL subunit. In a further embodiment, the complex comprises a first oligonucleotide and a second oligonucleotide, wherein the first oligonucleotide comprises a sequence complementary to an acceptor region of an exon of a gene encoding a MutS or MutL subunit, and wherein the second oligonucleotide comprises a sequence complementary to a donor region of an exon of a gene encoding a MutS or MutL subunit, and wherein the nucleic acid sequence of the second oligonucleotide comprises a nuclease-resistant modification. In one embodiment, the human MutS or MutL subunit comprises MSH2, MSH3, MSH6, MLH1, MLH3, PMS1, or PMS2. In one embodiment, the methods comprise the step of administering to the subject in need of treatment, a therapeutically effective amount of the oligonucleotide complex. The oligonucleotide complex of the present invention effectively modulates the activity of a MutS or MutL subunit, or modulates the expression of a MutS or MutL subunit. In one embodiment, the activity or expression of a MutS or MutL subunit in an subject is decreased by about 10% as compared to a control. In other embodiments, the activity or expression of a MutS or MutL subunit in a subject is decreased by about 20%. In yet other embodiments, the activity or expression of a MutS or MutL subunit in a subject is decreased by about 30%. In some embodiments, the activity or expression of a MutS or MutL subunit in a subject is decreased by about 50%. In some embodiments, the activity or expression of a MutS or MutL subunit in a subject is decreased by about 60%. In some embodiments, the activity or expression of a MutS or MutL subunit in a subject is decreased by about 70%. The oligonucleotide compounds disclosed herein (e.g., ASOs, SSOs, or oligonucleotide complexes) can modulate mRNA expression of a MutS or MutL subunit (such as MSH2, MSH3, MSH6, MLH1, MLH3, PMS1, or PMS2) by at least 10%, by at least 20%, by at least 25%, by at least 30%, by at least 40%, by at least 50%, by at least 60%, by at least 70%, by at least 75%, by at least 80%, by at least 85%, by at least 90%, by at least 95%, by at least 98%, by at least 99%, or by 100% as compared to a control. In one embodiment, the oligonucleotide comprises SEQ ID NO: 3. In one embodiment, the oligonucleotide comprises SEQ ID NO: 4. In one embodiment, the oligonucleotide comprises a nucleic acid sequence depicted in Table 4. In one embodiment, the oligonucleotide comprises an oligonucleotide compound that is directed to a nucleic acid sequence corresponding to a region of interest for any one of the exons 1-16 described herein for GenBank Accession No. NG_007110.2, or to an intron-exon junction, or to an exon-intron junction listed with GenBank Accession No. NG_007110.2. In one embodiment, the oligonucleotide comprises an oligonucleotide compound that is directed to a nucleic acid sequence corresponding to a region of interest for any one of the exons 1-24 described herein for GenBank Accession No. NG_016607.1, or to an intron-exon junction, or to an exon-intron junction listed with GenBank Accession No. NG_016607.1. In one embodiment, the oligonucleotide comprises an oligonucleotide compound that is directed to a nucleic acid sequence corresponding to a region of interest for any one of the exons 1-10 described herein for GenBank Accession No. NG_007111.1 or SEQ ID NO: 33, or to an intron-exon junction, or to an exon-intron junction listed with GenBank Accession No. NG_007111.1 or SEQ ID NO: 33. In one embodiment, the oligonucleotide comprises an oligonucleotide compound that is directed to a nucleic acid sequence corresponding to a region of interest for any one of the exons 1-19 described herein for GenBank Accession No. NG_007109.2, or to an intron-exon junction, or to an exon-intron junction listed with GenBank Accession No. NG_007109.2. In one embodiment, the oligonucleotide comprises an oligonucleotide compound that is directed to a nucleic acid sequence corresponding to a region of interest for any one of the exons 1-13 described herein for GenBank Accession No. NG_008648.1, or to an intron-exon junction, or to an exon-intron junction listed with GenBank Accession No. NG_008648.1. In one embodiment, the oligonucleotide comprises an oligonucleotide compound that is directed to a nucleic acid sequence corresponding to a region of interest for any one of the exons 1-13 described herein for GenBank Accession No. NG_008649.1 or SEQ ID NO: 1, or to an intron-exon junction, or to an exon-intron junction listed with GenBank Accession No. NG_008649.1 or SEQ ID NO: 1. In one embodiment, the oligonucleotide comprises an oligonucleotide compound that is directed to a nucleic acid sequence corresponding to a region of interest for any one of the exons 1-15 described herein for GenBank Accession No. NG_008466.1, or to an intron-exon junction, or to an exon-intron junction listed with GenBank Accession No. NG_008466.1.

For example, the decrease or reduction of the expression of a MutS or MutL subunit (such as MSH2, MSH3, MSH6, MLH1, MLH3, PMS1, or PMS2) can be measured in serum, blood, adipose tissue, cerebral spinal fluid, liver, or any other body fluid, tissue or organ of the subject. In one embodiment, the cells contained within the above-listed fluids, tissues or organs that are being analyzed contain a nucleic acid molecule encoding a MutS or MutL subunit (such as MSH2, MSH3, MSH6, MLH1, MLH3, PMS1, or PMS2).

Formulations and Administration

The oligonucleotide compounds of the invention can be utilized in pharmaceutical compositions by adding an effective amount of a compound to a suitable pharmaceutically acceptable diluent or carrier. Use of the oligonucleotide compounds and methods of the invention may also be useful prophylactically.

An "effective amount", "sufficient amount" or "therapeutically effective amount" as used herein is an amount of a composition that is sufficient to effect beneficial or desired results, including clinical results. As such, the effective amount may be sufficient, for example, to reduce or ameliorate the severity and/or duration of an affliction or condition, or one or more symptoms thereof, prevent the advancement of conditions related to an affliction or condition, prevent the recurrence, development, or onset of one or more symptoms associated with an affliction or condition, or enhance or otherwise improve the prophylactic or therapeutic effect(s) of another therapy. An effective amount also includes the amount of the composition (e.g., the oligonucleotide compounds discussed herein) that avoids or substantially attenuates undesirable side effects.

The term "carrier" refers to a diluent, adjuvant, excipient, or vehicle with which a compound is administered. Non-limiting examples of such pharmaceutical carriers include liquids, such as water and oils, including those of petroleum, animal, vegetable or synthetic origin, such as peanut oil, soybean oil, mineral oil, sesame oil and the like. The pharmaceutical carriers may also be saline, gum acacia, gelatin, starch paste, talc, keratin, colloidal silica, urea, and the like. In addition, auxiliary, stabilizing, thickening, lubricating and coloring agents may be used. Other examples of suitable pharmaceutical carriers are described in *Remington: The Science and Practice of Pharmacy*, 21$^{st}$ Edition (University of the Sciences in Philadelphia, ed., Lippincott Williams & Wilkins 2005); and Handbook of Pharmaceutical Excipients, 7$^{th}$ Edition (Raymond Rowe et al., ed., Pharmaceutical Press 2012); each hereby incorporated by reference in its entirety.

The term "pharmaceutically acceptable salts" refers to physiologically and pharmaceutically acceptable salts of the compounds of the invention: i.e., salts that retain the desired biological activity of the parent compound and do not impart undesired toxicological effects thereto. A pharmaceutically acceptable carrier can comprise any and all solvents, dispersion media, coatings, antibacterial and antifungal agents, isotonic and absorption delaying agents, and the like, compatible with pharmaceutical administration. The use of such media and agents for pharmaceutically active substances is well known in the art. Any conventional media or agent that is compatible with the active compound can be used. Supplementary active compounds can also be incorporated into the compositions. For oligonucleotide compounds, examples of pharmaceutically acceptable salts and their uses are further described in U.S. Pat. No. 6,287,860, which is hereby incorporated by reference in its entirety.

In one embodiment, modulation of a subunit of the MMR system (e.g., MSH2, MSH3, MSH6, MLH1, MLH3, PMS1, or PMS2) can be effected by administering one or more oligonucleotide compounds (e.g., ASOs or SSOs, naked or modified) to a subject in need thereof. In one embodiment, the prevention, amelioration, or treatment of a DRED that is related to abnormal expression, function, activity of a subunit of the MMR system (e.g., MSH2, MSH3, MSH6, MLH1, MLH3, PMS1, or PMS2) as compared to a normal control can also be effected by administering one or more oligonucleotide compounds (e.g., ASOs or SSOs, naked or modified) to a subject in need thereof. Embodiments of the present invention can be administered alone, or can be administered in a therapeutic cocktail or as a pharmaceutical composition. For example, a pharmaceutical composition can comprise embodiments of the present invention, and a saline solution that includes a phosphate buffer. Embodiments of the present invention can be administered using the means and doses described herein. Embodiments of the present invention can be administered in combination with a suitable carrier. In one embodiment, the oligonucleotide compounds of the invention (e.g., ASOs and SSOs) encompass any pharmaceutically acceptable salts, esters, or salts of such esters, or any other compound which, upon administration to a subject, provides (directly or indirectly) the biologically active metabolite or residue thereof.

A pharmaceutical composition of the invention is formulated to be compatible with its intended route of administration. Examples of routes of administration include parenteral, e.g., intravenous, intradermal, subcutaneous, oral (e.g., inhalation), transdermal (topical), transmucosal, and rectal administration. Solutions or suspensions used for parenteral, intradermal, or subcutaneous application can include the following components: a sterile diluent such as water for injection, saline solution, fixed oils, polyethylene glycols, glycerine, propylene glycol or other synthetic solvents; antibacterial agents such as benzyl alcohol or methyl parabens; antioxidants such as ascorbic acid or sodium bisulfite; chelating agents such as ethylenediaminetetraacetic acid; buffers such as acetates, citrates or phosphates and agents for the adjustment of tonicity such as sodium chloride or dextrose. pH can be adjusted with acids or bases, such as hydrochloric acid or sodium hydroxide. The parenteral preparation can be enclosed in ampoules, disposable syringes or multiple dose vials made of glass or plastic.

Pharmaceutical compositions suitable for injectable use include sterile aqueous solutions (where water soluble) or dispersions and sterile powders for the extemporaneous preparation of sterile injectable solutions or dispersions. For intravenous administration, suitable carriers include physiological saline, bacteriostatic water, Cremophor EM™ (BASF, Parsippany, N.J.) or phosphate buffered saline (PBS). In all cases, the composition must be sterile and should be fluid to the extent that easy syringability exists. It must be stable under the conditions of manufacture and storage and must be preserved against the contaminating action of microorganisms such as bacteria and fungi. The carrier can be a solvent or dispersion medium containing, for example, water, ethanol, a pharmaceutically acceptable polyol like glycerol, propylene glycol, liquid polyethylene glycol, and suitable mixtures thereof. The proper fluidity can be maintained, for example, by the use of a coating such as lecithin, by the maintenance of the required particle size in the case of dispersion and by the use of surfactants. Prevention of the action of microorganisms can be achieved by various antibacterial and antifungal agents, for example, parabens, chlorobutanol, phenol, ascorbic acid, and thimerosal. In many cases, it can be useful to include isotonic agents, for example, sugars, polyalcohols such as mannitol, sorbitol, sodium chloride in the composition. Prolonged absorption of the injectable compositions can be brought about by including in the composition an agent which delays absorption, for example, aluminum monostearate and gelatin.

Sterile injectable solutions can be prepared by incorporating the compound in the required amount in an appropriate solvent with one or a combination of ingredients enumerated herein, as required, followed by filtered sterilization. Generally, dispersions are prepared by incorporating the active compound into a sterile vehicle which contains a basic dispersion medium and the required other ingredients from those enumerated herein. In the case of sterile powders for the preparation of sterile injectable solutions, examples of useful preparation methods are vacuum drying and freeze-drying which yields a powder of the active ingredient plus any additional desired ingredient from a previously sterile-filtered solution thereof.

Oral compositions generally include an inert diluent or an edible carrier. They can be enclosed in gelatin capsules or compressed into tablets. For the purpose of oral therapeutic administration, the active compound can be incorporated with excipients and used in the form of tablets, troches, or capsules. Oral compositions can also be prepared using a fluid carrier for use as a mouthwash, wherein the compound in the fluid carrier is applied orally and swished and expectorated or swallowed.

Pharmaceutically compatible binding agents, and/or adjuvant materials can be included as part of the composition. The tablets, pills, capsules, troches and the like can contain any of the following ingredients, or compounds of a similar nature: a binder such as microcrystalline cellulose, gum tragacanth or gelatin; an excipient such as starch or lactose, a disintegrating agent such as alginic acid, Primogel, or corn starch; a lubricant such as magnesium stearate or sterotes; a glidant such as colloidal silicon dioxide; a sweetening agent such as sucrose or saccharin; or a flavoring agent such as peppermint, methyl salicylate, or orange flavoring.

Systemic administration can also be by transmucosal or transdermal means. For transmucosal or transdermal administration, penetrants appropriate to the barrier to be permeated are used in the formulation. Such penetrants are generally known in the art, and include, for example, for transmucosal administration, detergents, bile salts, and fusidic acid derivatives. Transmucosal administration can be accomplished through the use of nasal sprays or suppositories. For transdermal administration, the active compounds are formulated into ointments, salves, gels, or creams as generally known in the art.

The oligonucleotide compounds of the invention may also be admixed, encapsulated, conjugated or otherwise associated with other molecules, molecule structures or mixtures of compounds, as for example, liposomes, receptor-targeted molecules, oral, rectal, topical or other formulations, for assisting in uptake, distribution and/or absorption. Non-limiting examples of United States patents that teach the preparation of such uptake, distribution and/or absorption-assisting formulations include U.S. Pat. Nos. 5,108,921; 5,354,844; 5,416,016; 5,459,127; 5,521,291; 5,543,165; 5,547,932; 5,583,020; 5,591,721; 4,426,330; 4,534,899; 5,013,556; 5,108,921; 5,213,804; 5,227,170; 5,264,221; 5,356,633; 5,395,619; 5,416,016; 5,417,978; 5,462,854; 5,469,854; 5,512,295; 5,527,528; 5,534,259; 5,543,152; 5,556,948; 5,580,575; and 5,595.756, each of which is herein incorporated by reference.

For treating tissues in the central nervous system, administration can be made by, e.g., injection or infusion into the cerebrospinal fluid. Administration of antisense RNA into cerebrospinal fluid is described, e.g., in U.S. Pat. No. 7,622,455, which is incorporated by reference in its entirety. When it is intended that an oligonucleotide compound (e.g., an ASO or SSO) will be administered to cells of the central nervous system, administration can be with one or more agents capable of promoting penetration of the oligonucleotide compound across the blood-brain barrier. Injection can be made, e.g., in the entorhinal cortex or hippocampus. See also U.S. Pat. Nos. 6,632,427 and 6,756,523 for additional disclosures relating to direct delivery to the brain, each patent which is incorporated by reference in its entirety. For treating cardiac tissues, administration can be made by, e.g., injection or infusion into the bloodstream. The injection can be administered by the following routes: intraperitoneal injection, subcutaneous injection, intradermal injection, intravenous injection, intramuscular injection, intra-arterial injection, or a combination thereof. In one embodiment, administration into the bloodstream is useful to treat the heart, which is a major affected target in Friedreich ataxia.

Formulations useful for topical administration include those in which the oligonucleotide compounds of the invention are in admixture with a topical delivery agent such as lipids, liposomes, fatty acids, fatty acid esters, steroids, chelating agents and surfactants. Exemplary lipids and liposomes include neutral (e.g. diolcoyl-phosphatidyl ethanolamine (DOPE), dimyristoylphosphatidyl choline (DMPC), distearolyphosphatidyl choline) negative (e.g. dimyristoylphosphatidyl glycerol (DMPG)) and cationic (e.g. diolcoyltetramethyl-aminopropyl (DOTAP), and diolcoyl-phosphatidyl ethanolamine (DOTMA)). For topical or other administration, oligonucleotide compounds of the invention can be encapsulated within liposomes or can form complexes thereto, in particular to cationic liposomes. Alternatively, oligonucleotide compounds can be complexed to lipids, in particular to cationic lipids. Exemplary fatty acids and esters, pharmaceutically acceptable salts thereof, and their uses are further described in U.S. Pat. No. 6,287,860, which is hereby incorporated by reference in its entirety.

The formulation of therapeutic compositions and their subsequent administration (dosing) is believed to be within the skill of those in the art. Dosing is dependent on severity and responsiveness of the disease state to be treated, with the course of treatment lasting from several days to several months, or until a cure is effected or a diminution of the disease state is achieved. Optimal dosing schedules can be calculated from measurements of drug accumulation in the body of the patient. Persons of ordinary skill can easily determine optimum dosages, dosing methodologies and repetition rates. Optimum dosages may vary depending on the relative potency of individual oligonucleotides, and can generally be estimated based on $EC_{50}$s found to be effective in in vitro and in vivo animal models. In some embodiments, the therapeutically effective amount is at least about 0.1 mg/kg body weight, at least about 0.25 mg/kg body weight, at least about 0.5 mg/kg body weight, at least about 0.75 mg/kg body weight, at least about 1 mg/kg body weight, at least about 2 mg/kg body weight, at least about 3 mg/kg body weight, at least about 4 mg/kg body weight, at least about 5 mg/kg body weight, at least about 6 mg/kg body weight, at least about 7 mg/kg body weight, at least about 8 mg/kg body weight, at least about 9 mg/kg body weight, at least about 10 mg/kg body weight, at least about 15 mg/kg body weight, at least about 20 mg/kg body weight, at least about 25 mg/kg body weight, at least about 30 mg/kg body weight, at least about 40 mg/kg body weight, at least about 50 mg/kg body weight, at least about 75 mg/kg body weight, at least about 100 mg/kg body weight, at least about 200 mg/kg body weight, at least about 250 mg/kg body weight, at least about 300 mg/kg body weight, at least about 350 mg/kg body weight, at least about 400 mg/kg body weight, at least about 450 mg/kg body weight, or at least about 500 mg/kg body weight.

In one embodiment, the oligonucleotide compound can be administered to the subject one time (e.g., as a single injection or deposition). Alternatively, administration can be once or twice daily to a subject in need thereof for a period of from about 2 to about 28 days, or from about 7 to about 10 days, or from about 7 to about 15 days. It can also be administered once or twice daily to a subject for a period of 1, 2, 3, 4, 5, 6, 7, 8, 9, 10, 11, 12 times per year, or a combination thereof. For example, the dosage may be given once or more daily, weekly, monthly or yearly, or even once every 2 to 20 years. In one embodiment, two or more combined oligonucleotide compounds, therapeutics, and the like may be used together in combination or sequentially. The dosage can vary depending upon known factors such as the pharmacodynamic characteristics of the active ingredient and its mode and route of administration; time of administration of active ingredient; age, sex, health and weight of the recipient; nature and extent of symptoms; kind of concurrent treatment, frequency of treatment and the effect desired; and rate of excretion. Persons of ordinary skill in the art can easily estimate repetition rates for dosing based on measured residence times and concentrations of the drug in bodily fluids or tissues. Following successful treatment, it may be desirable to have the patient undergo maintenance therapy to prevent the recurrence of the disease state, wherein the oligonucleotide compound is administered in maintenance doses, ranging from at least about 0.1 mg/kg body weight to about 10 mg/kg of body weight, once or more daily, to once every 2-20 years. Certain injected dosages of antisense oligonucleotides, for example, are described, in U.S. Pat. No. 7,563,884, which is hereby incorporated by reference in its entirety.

While the embodiments of the present invention are described with reference to various implementations and exploitations, it will be understood that these embodiments are illustrative and that the scope of the inventions is not limited to them. Many variations, modifications, additions, and improvements are possible. Further still, any steps described herein may be carried out in any desired order, and any desired steps may be added or deleted. Support for the present invention and additional embodiments of the present invention may be found in the attached documents all of which are expressly incorporated herein in their entirety by reference hereto. Also, the phraseology and terminology used herein is for the purpose of description and should not be regarded as limiting. The use of "including," "comprising," or "having," "containing," "involving," and variations thereof herein, is meant to encompass the items listed thereafter and equivalents thereof as well as additional items.

Unless otherwise defined, all technical and scientific terms used herein have the same meaning as commonly understood by one of ordinary skill in the art to which this invention belongs. Exemplary methods and materials are described below, although methods and materials similar or equivalent to those described herein can also be used in the practice or testing of the present invention.

As will be apparent to one of ordinary skill in the art from a reading of this disclosure, the embodiments of the present disclosure can be embodied in forms other than those specifically disclosed above. The particular embodiments described herein are, therefore, to be considered as illustrative and not restrictive. Those skilled in the art will recognize, or be able to ascertain, using no more than routine experimentation, numerous equivalents to the specific embodiments described herein. The scope of the invention is as set forth in the appended claims and equivalents thereof, rather than being limited to the examples contained in the foregoing description.

All publications and other references mentioned herein are incorporated by reference in their entirety, as if each individual publication or reference were specifically and individually indicated to be incorporated by reference. Publications and references cited herein are not admitted to be prior art.

EXAMPLES

Examples are provided below to facilitate a more complete understanding of the invention. The following examples illustrate the exemplary modes of making and practicing the invention. However, the scope of the invention is not limited to specific embodiments disclosed in these Examples, which are for purposes of illustration only, since alternative methods can be utilized to obtain similar results.

Example 1

Friedreich Ataxia is Characterized by Progressive Repeat Expansion

Friedreich ataxia (FRDA) is a progressive neurodegenerative disorder caused by GAA•TTC repeat expansion in the first intron of the frataxin (FXN) gene (3). Disease severity correlates to the length of the expanded repeats and the consequent reduction of FXN gene expression. While the mechanism of repeat expansion is not yet understood, we have developed versatile human cell models with an integrated "tandem reporter" (15) that recapitulate the expansion seen in FRDA patients that have allowed us to make rapid progress in understanding the expansion process.

This model has a key advantage over authentic FXN repeat expansion: the repeats are not linked to an essential gene. Thus, the well-known problems associated with selection against frataxin knockdown cells in culture are able to be avoided (16). Further advantages of this system include a single copy genomic location, the ability to control the transcription into a repeat, and a cell environment permissive for expansion. The "tandem reporter" expansion system uses modified HEK293 cells. These cells express a large number of proteins typically expressed exclusively, or preferentially, in neurons probably due to preferential transformation of neuronal lineage by adenovirus 5 in embryonic kidney (17,18). The ability to study expansion with an accelerated time course is aided by the neuronal nature of HEK293 cells. Long uninterrupted GAA•TTC repeats cannot be propagated in bacteria. Therefore repeat arrays are built for the constructs using an in vitro ligation strategy devised (19) circumventing bacteria. This gives the system another advantage since defined, uninterrupted repeats are used.

In models, the repeats expand incrementally, continuously and nearly synchronously. Importantly, the rate of expansion is linked to the level of transcription into the repeats (20). Thus, some therapeutic strategies aimed at increasing transcription of the FXN gene will inadvertently increase repeat expansion.

These models have been used to determine that MSH3 (MutSbeta) is required for GAA•TTC repeat expansion (21). MutSbeta is comprised of MSH2 and MSH3, and binds to a site targeted for mismatch repair. Multiple lines of evidence highlight the importance of MutSbeta in repeat expansion: (i) shRNA knockdown of either MSH2 or MSH3 slowed GAA•TTC expansion in human cells, and (ii) ectopic expression of MutSbeta induced GAA•TTC repeat expansion in the native FXN gene. Once it binds to DNA to initiate repeat expansion, MutSbeta recruits a MutL complex.

The models have also been used to determine that MLH1 complexed with MLH3 (MutLgamma) is the next step required for GAA•TTC repeat expansion. Furthermore, MLH3 is involved in repeat expansion and only one of the two MLH3 alternative splicing isoforms is required.

Human MLH3 has 2 Isoforms

Figure 9A:
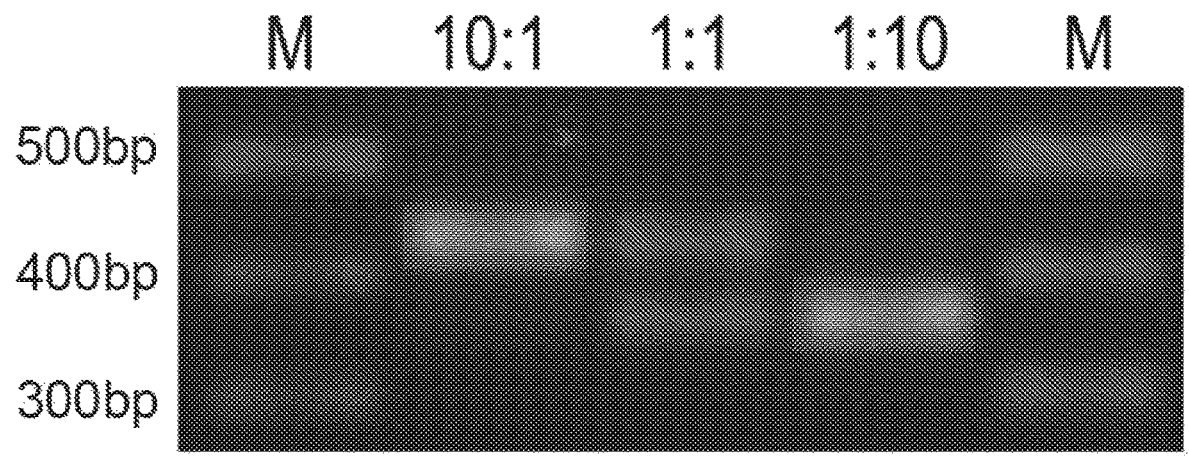
FIG. 9A is a photographic image of gel showing detection of MLH3 isoforms 1 and 2. Defined templates containing or excluding MLH3 exon 7 were mixed in 10:1, 1:1 and 1:10 ratios. Primer pairs, MLH3 L3324 and MLH3 R3757 detected MLH3 isoforms 1 and 2. M: A 1 kb plus size standard showing 500 bp, 400 bp, and 300 bp.
Figure 9B:
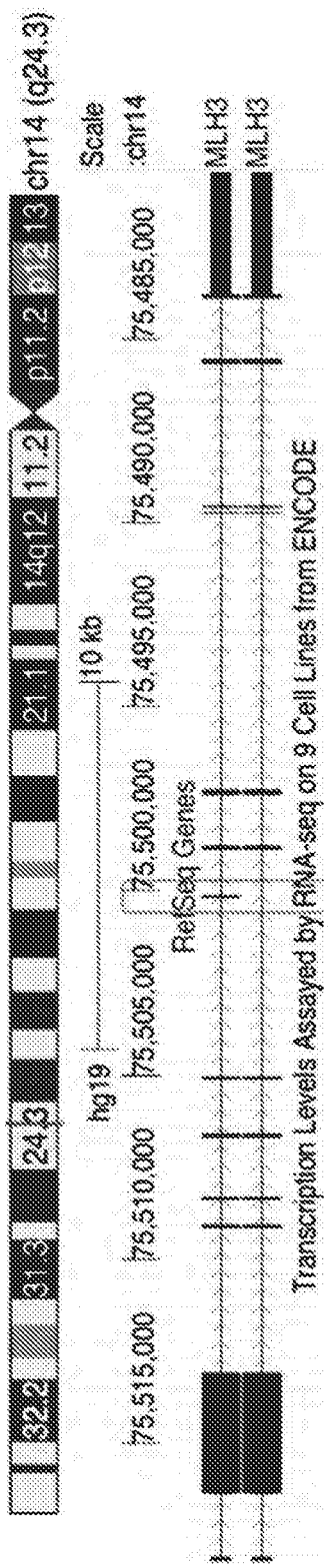
FIG. 9B is a schematic showing that MLH3, a component of a MutL complex, has 2 isoforms due to alternative splicing. MLH3 iso1 has exon 7 and MLH3 iso2 lacks exon 7.
Figure 10:
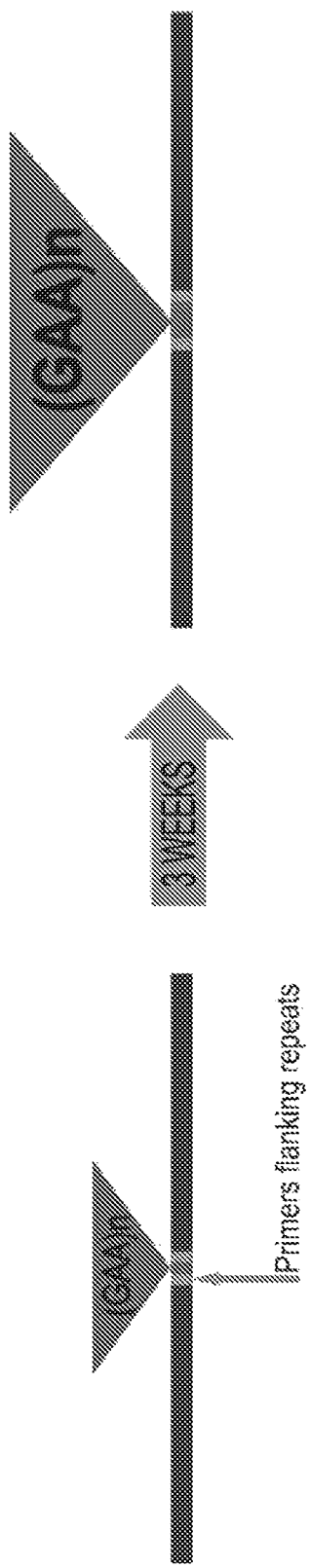
FIG. 10 is a schematic illustrating that MLH3 iso1 is required for expansion by following expansion in a human cell model. Single genomic construct, rather than 2 alleles simplifies analysis. Because the GAA•TTC repeat is not in the FXN gene in the model cell, repeat expansion is freed from the negative effect of insufficient FXN. Primers targeted for unique flanking sequences. GAA•TTC repeats expand incrementally and continuously in these model cells.

MLH3 is expressed in humans as two isoforms, MLH3iso1 and MLH3iso2, resulting from alternative splicing. MLH3iso1 includes exon 7, which contains a highly conserved portion of an endonuclease domain, while MLH3 isoform 2 lacks this 72 base exon (FIG. 9B). Primer pairs, MLH3 L3324 and MLH3 R3757, were used to detect MLH3iso1 and MLH3iso2 (FIG. 9A). This pair resulted in a 434 bp band for MLH3iso1 and a 362 bp band for MLH3iso2; a 16.6% difference allowing easy visualization of the presence or absence of the 72 nucleotide long exon 7. Dilutions of defined isoform templates containing or excluding exon 7 were done in 10:1, 1:1, and 1:10 respectively to demonstrate the quantitative nature of this PCR.

Forcing MLH3 Exon Choice

Figure 5:
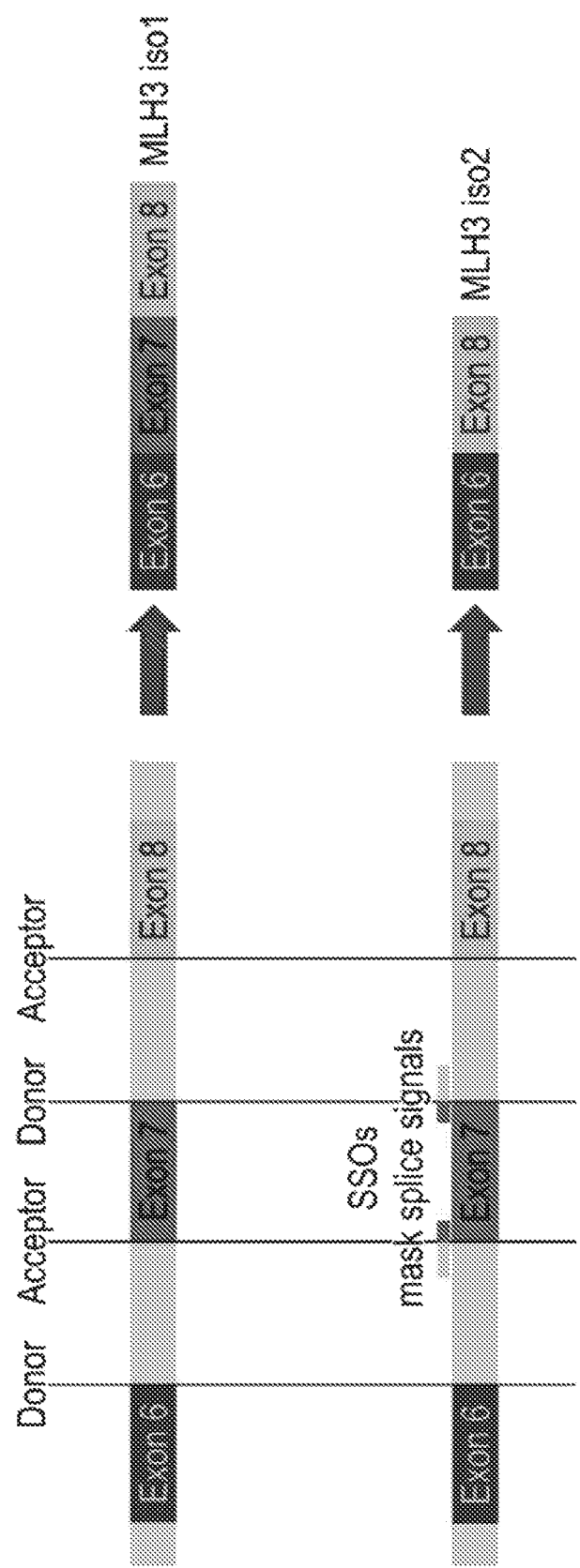
FIG. 5 is a schematic showing that splice switching oligos (SSOs) were designed to bind the acceptor or donor region of MLH3 exon 7 in pre-mRNA. These SSOs were used to induce skipping of exon 7 and preferential production of MLH3 splice isoform 2 (iso2).

MLH3 expression is key to GAA•TTC expansion in human cells. Manipulation of this minor component of MMR in a repeat expansion model may be a possible therapeutic target to limit DNA repeat expansion in FRDA patients. As MLH3iso2 lacks exon 7, which contains part of its endonuclease domain, forced expression of this isoform may serve such a purpose. Splice switching oligos (SSOs) were designed to mask the acceptor and donor regions of MLH3 exon 7, inducing skipping of exon 7 and the consequent production of MLH3iso2 (FIG. 5). Forcing exclusion of exon 7 may approximate a functional knockout of the endonuclease activity of MLH3, which is critical for repeat expansion. Skipping exon 7 leaves MLH3 isoform 2 intact, so will not impact the total cellular ratios of MLH1 and its binding partners PMS2, PMS1 and MLH3. Exemplary SSOs are depicted in SEQ ID NOS: 3 and 4 below:

```
ML3X7acceptor6
                                    (SEQ ID NO: 3)
5'-TCCCACctagatgagcaaggattgt-3'

ML3X7donor8
                                    (SEQ ID NO: 4)
5'-tctggctgcaaacagatccttacCA-3'
```

Small Molecule Directed Skipping of MLH3 Exon 7 Slows GAA•TTC Repeat Expansion

Figure 6:
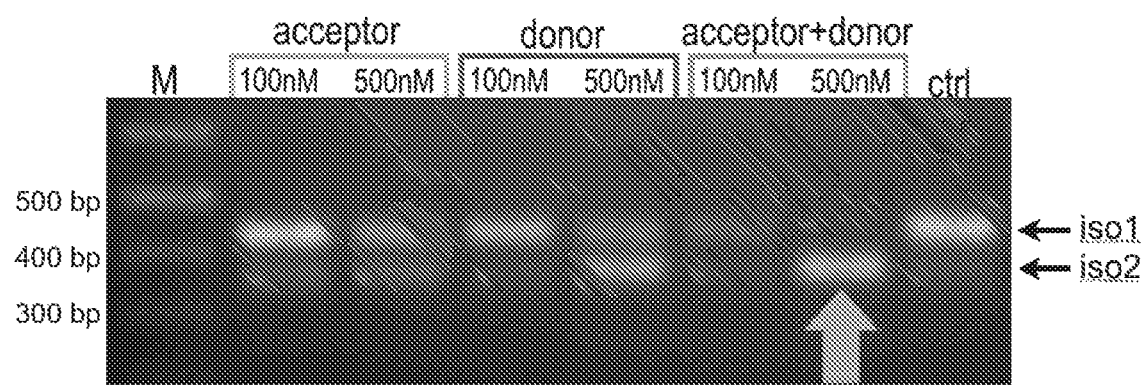
FIG. 6 is a photographic image of a gel showing that RT-PCR demonstrates exon skipping in MLH3 mRNA from SSO treated cells. Acceptor, donor or both SSOs were given twice a week to FRDA rapid expansion model cells in culture. Cells were assessed for MLH3 isoform expression with RT-PCR. The combination of acceptor and donor SSOs at 500 nM effectively excluded exon 7 as shown in lane 6 (arrow). M: Alkb plus size standard showing 650 bp, 500 bp, 400 bp, 300 bp and 200 bp.
Figure 7:
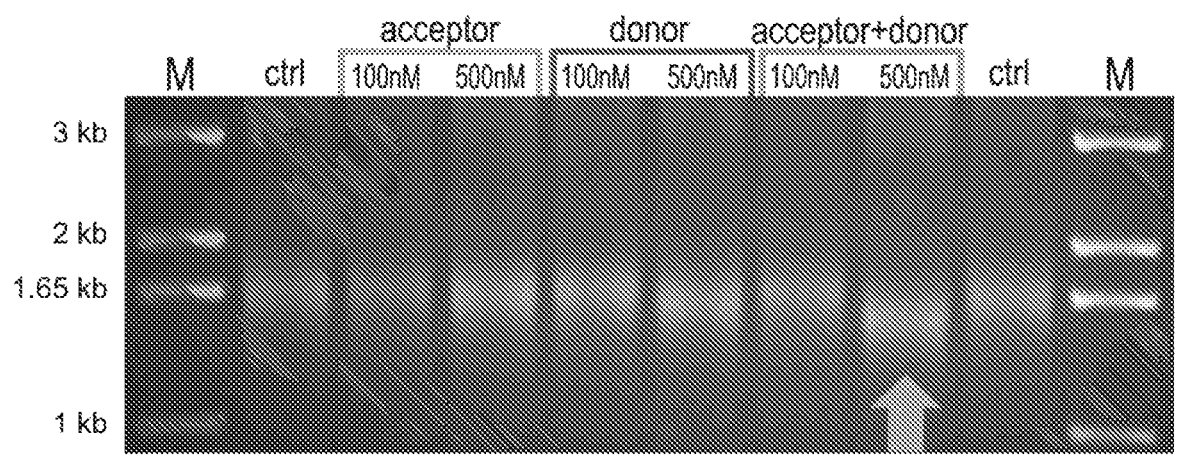
FIG. 7 is a photographic image of a PCR analytic gel showing that preferential expression of MLH3 isoform 2 leads to slower GAA•TTC repeat expansion. PCR analysis of GAA•TTC expansion at week 3 with indicated treatments. Repeat size assay PCR product equals 500 bp flanking sequence+3×(repeats). Sample 6 with 250 nM each of both acceptor and donor SSOs slowed expansion (arrow). M: Alkb plus size standard showing 3,000 bp, 2,000 bp, 1,650 bp, and 1,000 bp.

These cells were treated with splice switching oligonucleotides designed to exclude exon 7 of MLH3, so that the cells would preferentially make MLH3iso2. Specifically, acceptor, donor or both SSOs were given twice a week to FRDA model cells in culture. After 3 weeks in culture with various treatments, RT-PCR was used to measure the relative expression of MLH3iso1 and MLH3iso2, and PCR on genomic DNA was used to measure the length of the GAA•TTC repeat. RT-PCR demonstrates that the combination of acceptor and donor SSOs at 500 nM most effectively excluded exon 7 (FIG. 6). Correlated with the preferential expression of MLH3iso2, PCR analysis of GAA•TTC expansion shows a reduced expansion rate (FIG. 7).

From these experiments, it is concluded that (i) MLH3 contributes to GAA•TTC repeat expansion in human cells, (ii) the endonuclease domain of MLH3 is needed for this effect, and (iii) a small molecule therapeutic directed at skipping of MLH3 exon 7 may be therapeutic avenue to slow the progression of repeat expansion disorders such as Friedreich ataxia.

REFERENCES

1. Gatchel, J. R. and Zoghbi, H. Y. (2005) Diseases of unstable repeat expansion: mechanisms and common principles. Nature reviews. Genetics, 6, 743-755.
2. Mirkin, S. M. (2007) Expandable DNA repeats and human disease. Nature, 447, 932-940.
3. Campuzano, V., Montermini, L., Molto, M. D., Pianese, L., Cossee, M., Cavalcanti, F., Monros, E., Rodius, F., Duclos, F., Monticelli, A. et al. (1996) Friedreich's ataxia: autosomal recessive disease caused by an intronic GAA triplet repeat expansion. Science, 271, 1423-1427.
4. Chauhan, C., Dash, D., Grover, D., Rajamani, J. and Mukerji, M. (2002) Origin and instability of GAA repeats: insights from Alu elements. J Biomol Struct Dyn, 20, 253-263.
5. Clark, R. M., Dalgliesh, G. L., Endres, D., Gomez, M., Taylor, J. and Bidichandani, S. I. (2004) Expansion of GAA triplet repeats in the human genome: unique origin of the FRDA mutation at the center of an Alu. Genomics, 83, 373-383.
6. Batzer, M. A. and Deininger, P. L. (2002) Alu repeats and human genomic diversity. Nature reviews. Genetics, 3, 370-379.
7. Matsuura, T., Fang, P., Lin, X., Khajavi, M., Tsuji, K., Rasmussen, A., Grewal, R. P., Achari, M., Alonso, M. E., Pulst, S. M. et al. (2004) Somatic and germline instability of the ATTCT repeat in spinocerebellar ataxia type 10. American journal of human genetics, 74, 1216-1224.
8. Kurosaki, T., Ueda, S., Ishida, T., Abe, K., Ohno, K. and Matsuura, T. (2012) The unstable CCTG repeat responsible for myotonic dystrophy type 2 originates from an AluSx element insertion into an early primate genome. PloS one, 7, e38379.
9. Prolla, T. A., Pang, Q., Alani, E., Kolodner, R. D. and Liskay, R. M. (1994) MLH1, PMS1, and MSH2 interactions during the initiation of DNA mismatch repair in yeast. Science, 265, 1091-1093.
10. Flores-Rozas, H. and Kolodner, R. D. (1998) The Saccharomyces cerevisiae MLH3 gene functions in MSH3-dependent suppression of frameshift mutations. Proceedings of the National Academy of Sciences of the United States of America, 95, 12404-12409.
11. Raschle, M., Marra, G., Nystrom-Lahti, M., Schar, P. and Jiricny, J. (1999) Identification of hMutLbeta, a heterodimer of hMLH1 and hPMS1. The Journal of biological chemistry, 274, 32368-32375.
12. Lipkin, S. M., Wang, V., Jacoby, R., Banerjee-Basu, S., Baxevanis, A D., Lynch, H. T., Elliott, R. M. and Collins, F. S. (2000) MLH3: a DNA mismatch repair gene associated with mammalian microsatellite instability. Nature genetics, 24, 27-35.
13. Tian, L., Hou, C., Tian, K., Holcomb, N. C., Gu, L. and Li, G. M. (2009) Mismatch recognition protein MutSbeta does not hijack (CAG)n hairpin repair in vitro. The Journal of biological chemistry, 284, 20452-20456.
14. Cannavo, E., Marra, G., Sabates-Bellver, J., Menigatti, M., Lipkin, S. M., Fischer, F., Cejka, P. and Jiricny, J. (2005) Expression of the MutL homologue hMLH3 in human cells and its role in DNA mismatch repair. Cancer Res, 65, 10759-10766.
15. Banerjee, A., Sammarco, M. C., Ditch, S., Wang, J. and Grabczyk, E. (2009) A novel tandem reporter quantifies RNA polymerase II termination in mammalian cells. PloS one, 4, e6193.
16. Calmels, N., Seznec, H., Villa, P., Reutenauer, L., Hibert, M., Haiech, J., Rustin, P., Koenig, M. and Puccio, H. (2009) Limitations in a frataxin knockdown cell model for Friedreich ataxia in a high-throughput drug screen. BMC Neurol, 9, 46.
17. Graham, F. L., Smiley, J., Russell, W. C. and Nairn, R. (1977) Characteristics of a human cell line transformed by DNA from human adenovirus type 5. The Journal of general virology, 36, 59-74.
18. Shaw, G., Morse, S., Ararat, M. and Graham, F. L. (2002) Preferential transformation of human neuronal cells by human adenoviruses and the origin of HEK 293 cells. The FASEB journal: official publication of the Federation of American Societies for Experimental Biology, 16, 869-871.
19. Grabczyk, E. and Usdin, K. (1999) Generation of microgram quantities of trinucleotide repeat tracts of defined length, interspersion pattern, and orientation. Analytical biochemistry, 267, 241-243.
20. Ditch, S., Sammarco, M. C., Banerjee, A. and Grabczyk, E. (2009) Progressive GAA•TTC repeat expansion in human cell lines. PLoS genetics, 5, e1000704.

21. Halabi, A., Ditch, S., Wang, J. and Grabczyk, E. (2012) DNA mismatch repair complex MutSbeta promotes GAA.TTC repeat expansion in human cells. *The Journal of biological chemistry*, 287, 29958-29967.

Example 2

MLH3 expression is key to GAA•TTC expansion in human cells and forms the basis for the first therapeutic to slow the expansion rate in Friedreich ataxia and perhaps other repeat expansion diseases. This minor component of mismatch repair (MMR) will be developed as a therapeutic target to limit repeat expansion in FRDA patients. in vivo efficacy and safety studies will be conducted in a mouse model. Without being bound by theory, selective expansion of GAA•TTC repeats in disease relevant tissues to a critical size drives disease onset and progression in FRDA. Somatic expansion of GAA•TTC repeats requires transcription through the repeat then the sequential actions of MutSβ (MSH2/MSH3 heterodimer) and MutLγ (MLH1/MLH3 heterodimer). MSH3 expression was linked to active GAA•TTC expansion in FRDA patient primary cells (G1). Similarly, MMR or MSH3 expression has been linked to region specific expansion of CAG•CTG repeats in the Huntington's disease (HD) "R6" mouse model (G2-G4). MLH3 operates downstream of MSH3. Without being bound by theory, MLH3, while a minor player in canonical MMR, is a major force in DNA repeat expansion. MLH3 has also recently been identified as a component of CAG•CTG expansion in the HD "R6" mouse (G5).

Like the HD "R6" mouse, the FRDA "YG22" mouse model exhibits region specific GAA•TTC repeat expansion (G6). Splice-switching oligonucleotides (SSOs) will be used to block this expansion as a first step leading to human trials. The SSOs will be targeted to the mismatch repair protein MLH3. MLH3 is expressed in humans as two isoforms, MLH3 isoform 1 and MLH3 isoform 2, due to alternative splicing. MLH3 isoform 1 includes exon 7, which contains a conserved endonuclease domain, while MLH3 isoform 2 lacks exon 7. It has been recently found that MLH3 isoform 1 is required for GAA•TTC expansion, while isoform 2 is not. Skipping exon 7 by use of SSOs effectively shifts MLH3 to isoform 2 and stops repeat expansion in human cells. Finally, skipping exon 7 leaves MLH3 isoform 2 intact, the total cellular ratios of MLH1 and its binding partners PMS2, PMS1 and MLH3 will not be impacted. The mouse MLH3 exon structure parallels that of humans.

This approach targets a central mechanism that is likely shared by all repeat expansion diseases. Therefore, it has the potential to treat many, if not all of the diseases in this class. The SSOs to be used are the same type already in human trials for Duchene muscular dystrophy (G7-G9). Consequently, this project has great translational potential.

MMR has been implicated in repeat expansions of numerous disorders including Huntington's disease (HD) and myotonic dystrophy (DM) (G10-G13). Although somatic mosaicism of GAA•TTC allele size in FRDA patients has long been known (G14-G16) consideration of a role for MMR in the underlying GAA•TTC repeat expansion is more recent (G1,G17-G19).

In the MMR pathway, MutS heterodimers are responsible for identifying and binding mismatched bases and/or insertion/deletion loops of varying size (G20). MSH2 (MutS Homologue 2) is a component of both MutS complexes and has consequently been implicated in DNA repeat expansion (G10, G17, G19). Upon mismatch recognition by a MutS complex, a MutL heterodimer is recruited to make an incision near the lesion recognition site (G21-G23). Under physiologic conditions, binding of MutL initiates recruitment of the necessary machinery that will excise the lesion and synthesize the DNA patch.

While the mechanism of repeat expansion is not yet fully understood, that GAA•TTC expansion rate is associated with transcription within the repeat (FIGS. 1A-F) and requires the action of mismatch repair (MMR) complex MutSb rather than MutSa (G1, G24). Much of the accumulated evidence agrees that the MutSb complex, and/or the MSH3 subunit in particular, is rate limiting for expansion seen in Huntington's disease (HD), myotonic dystrophy (DM) (G12, G13, G25, G26) as well as in FRDA (G1).

Analogous to the role of MSH2 in MutS complexes, MLH1 (MutL Homologue 1) is the core subunit of known MutL complexes. MLH1 combines with one of three partners called PMS1 (post-meiotic segregation increased 1), PMS2, and MLH3 to form MutLb, MutLa, and MutLg respectively. It is estimated that about 90% of MLH1 in most human cells is bound to PMS2 (MutLa) (G28, G29); further, PMS1 and PMS2 are estimated to be present in 10 fold and 60 fold molar excess of MLH3 (G29). MutLα and MutLg appear to have a role in MMR while MutLb does not. As with MSH2, MLH1 depletion is strongly associated with hereditary nonpolyposis colorectal cancer (HNPCC) and sporadic gastric and endometrial carcinomas (G30-G32); PMS2 depletion is also associated with HNPPC albeit to a lesser extent than MLH1. Currently, evidence for MLH3 indicates that it rarely, if ever, contributes to cancer development (G33-G35).

PMS1, PMS2, and MLH3 have all been reported to compete for the same binding site on the C-terminal of MLH1 (G36); as with the MutS homologues, it is possible that the abundance of these proteins in relation to one another regulates their ability to compete for MLH1 and hence, their stability. Expression of MLH1 and PMS2 correlate strongly; however, evidence for MLH3 implicates that in addition to its already low abundance, MLH3 expression may not be tethered to the expression of other MutL proteins (G29). Generally, MLH3 is better understood for its role in meiotic recombination and the repair of frame-shift mutations than in canonical MMR (G37, G38). Interactions between MLH3, MLH1, and MSH3 have all been reported (G36-G38).

In the current working model shown in FIGS. 1A-F, resolution of a structure formed by transcription causes an out-of-register re-annealing of the two strands that leads to loop-outs. Without being bound by theory, the MMR pathway is aberrantly activated by these small loop-outs in the repeat. The contribution of MutL subunits to GAA•TTC repeat expansion will be assessed in the human cellular model of FRDA. Expression of MLH1, PMS2, and MLH3 was depleted in the cellular model and changes in expansion rate over time were quantified.

MLH3 Expression is Key to GAA•TTC Expansion in Human Cells.

Figure 2:
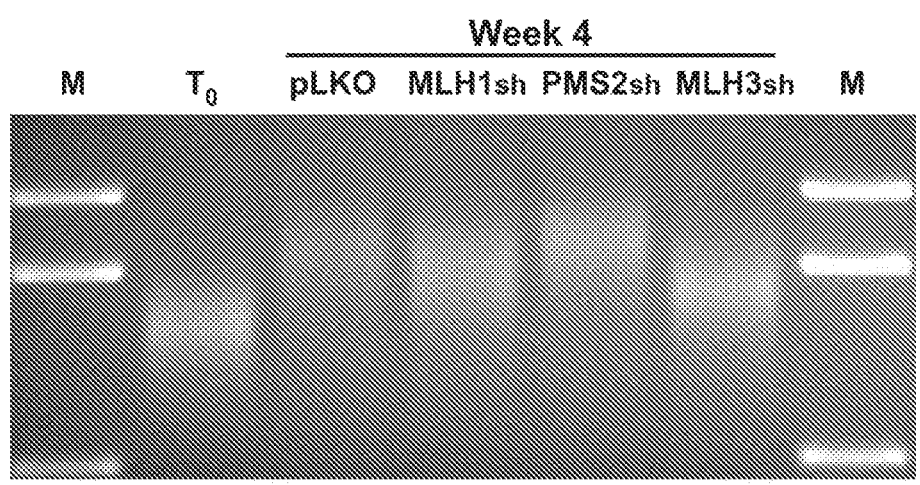
FIGS. 2A-B show the knockdown of MLH1 or MLH3 significantly reduces GAA•TTC expansion rate in FRDA model cells. Four independent lines were transduced with the indicated knockdown lentiviral pools.
Figure 2:
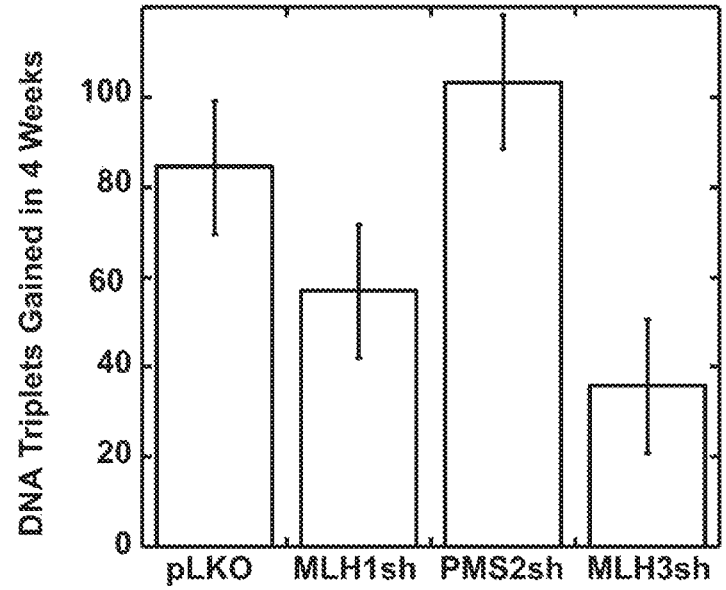
Figure 3:
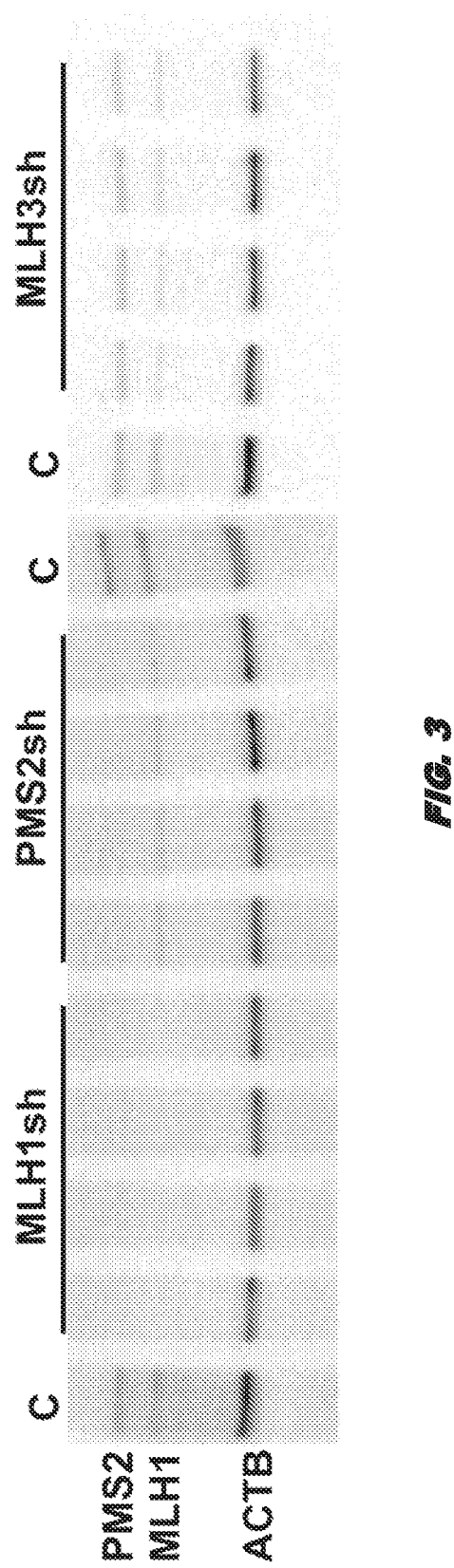
FIG. 3 shows that MLH3 knockdown does not affect MutLα expression. Western blot probed for PMS2, MLH1 and ACTB (β-actin) shows long-term lentiviral-mediated shRNA knockdown of MLH1, PMS2 and MLH3 protein in the cells used for DNA in FIGS. 2A-B. Knockdown of MLH1 concurrently depletes PMS2 (lanes MLH1sh). Knockdown of PMS2 halves MLH1 levels (lanes PMS2sh). Knockdown of MLH3 has a little effect on MLH1 protein levels, and no effect on PMS2 levels (lanes MLH3sh). None of the MLH3 antibodies tried were effective for western blots.

Lentiviral mediated shRNA knockdown of MLH1, PMS2 and MLH3 was carried out in four independent clones of HEK293 cells carrying a single copy of the tandem reporter vector bearing 176 GAA•TTC repeats (G24). Each knockdown used a pool of four shRNA-expressing lentivirus. After 4 weeks in culture, DNA and protein extracts were prepared as described previously (G1). A representative PCR sizing gel is shown in FIG. 2A. DNA from MLH1 knockdown cells (MLH1sh) can be seen to have reduced expansion compared to the empty vector control cells (pLKO) at week 4. DNA from MLH3 knockdown cells exhibit the least expansion (MLH3sh). The number of triplet repeats gained in 4 weeks was calculated for all four cell lines and presented in graphical form in FIG. 2B. MLH1 knockdown and MLH3 knockdown each showed a substantial and statistically significant reduction in expansion rate. In contrast, PMS2 knockdown samples showed a trend towards greater expansion. Thus shRNA knockdown of MMR proteins MLH1 and MLH3, but not PMS2 slows GAA•TTC expansion in human cells, indicating a role for MutLg Like MutS, MutL partners are more stable as heterodimers (G28). Western blot analysis of protein extracts from the cells showed the expected reduction of both PMS2 and MLH1 in the MLH1 knockdown cells as compared to controls (FIG. 3 compare lanes MLH1sh and lanes C). When PMS2 was knocked down, the protein level of MLH1 decreased, but was still evident (FIG. 3 lanes PMS2sh). In contrast with MLH1 and PMS2, MLH3 knockdown led to a slight decrease in MLH1 protein but PMS2 protein did not change. Because PMS2 stability depends on binding to MLH1, the lack of change in PMS2 with MLH3 knockdown indicates that MutLα levels are unaffected by the loss of MLH3 in these cells.

Taken together these data indicate that the necessary complex for GAA•TTC expansion is MutLg a heterodimer of MLH1 and MLH3. The lack of connection between MLH3 and cancer (G33-G35), and that reducing MLH3 levels did not affect levels of MutSa, which is linked to cancer (G30-G32), suggested MLH3 as a possible therapeutic target to limit DNA repeat expansion in FRDA patients.

MLH3 Exon Skipping as an Alternative to MLH3 Knockdown.

Figure 4:
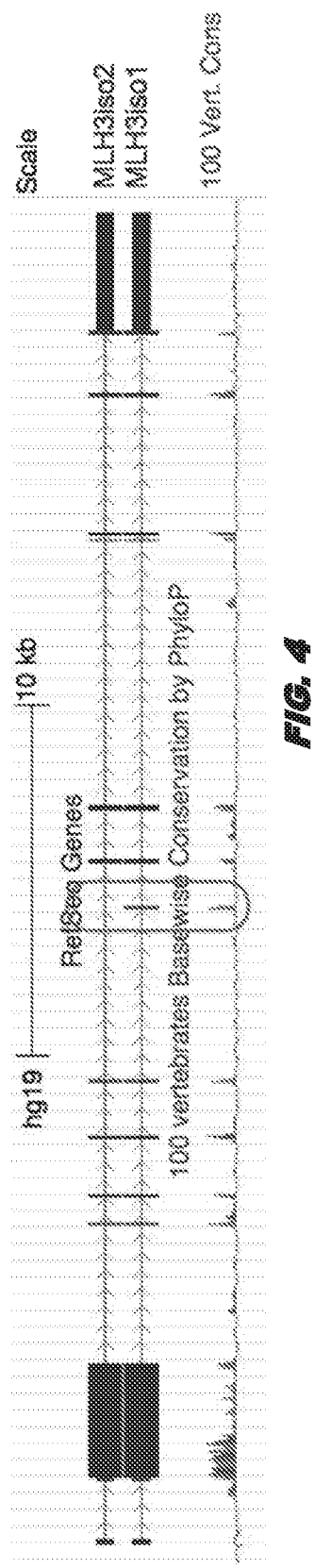
FIG. 4 is a schematic showing that human MLH3, a component of MutLg has 2 isoforms. MLH3 isoform 1 includes exon 7, which contains a highly conserved portion of an endonuclease domain, while MLH3 isoform 2 lacks this 72 base exon. Excluding exon 7 would approximate a functional knock out if the endonuclease activity of MLH3 is critical to repeat expansion.

MLH3 is expressed in humans as two isoforms (FIG. 4). MLH3 isoform 1 includes exon 7, which contains a highly conserved portion of an endonuclease domain, while MLH3 isoform 2 lacks this 72 base exon (FIG. 4). Without being bound by theory, if the endonuclease activity of MLH3 is critical to repeat expansion, then exclusion of exon 7 would stop repeat expansion. Skipping exon 7 leaves MLH3 isoform 2 intact, and therefore does not impact the cellular ratios of MLH1 and its binding partners PMS2, PMS1 and MLH3.

MLH3 exon 7 was skipped using oligonucleotide analogues that would bind and mask the splice donor and acceptor signals flanking exon 7 in the unspliced pre-mRNA (FIG. 5). DNA oligonucleotides were also designed to assay the ratio of MLH3 isoform 1 and MLH3 isoform 2 mRNA via reverse transcription PCR (RT-PCR) in order to quantify the efficacy of the SSOs.

Morpholinos are oligonucleotide analogues that bind their complementary target DNA or RNA very tightly due to their uncharged backbone of morpholino subunits, which also makes them resistant to nucleases and proteases (G39). The SSOs used in tissue culture are "vivo-morpholinos" that have an octaguanidine moiety conjugated to the morpholino to enhance cellular uptake (G40).

SSOs Effectively Changed MLH3 from Isoform 1 to Isoform 2 and Reduced Repeat Expansion.

Different concentrations of acceptor SSO, donor SSO and combinations of the two were examined. An example of the experiments conducted with the SSOs is shown in FIG. 6. The acceptor SSO gave a graded concentration dependent effect on exon skipping and the donor SSO was somewhat more effective, showing a steeper gradient. However, efficacy of splice switching was greatly enhanced when donor and acceptor SSOs were used in combination (FIG. 6, arrow).

The effect that the SSOs had on MLH3 isoforms was mirrored by the effect the SSOs had on repeat expansion (FIG. 7). The SSO combinations and concentrations that effectively switch MLH3 to isoform 2, also slowed GAA•TTC repeat expansion (compare FIGS. 6 and 7).

That splice-switching oligonucleotide directed skipping of MLH3 exon 7 slows GAA•TTC repeat expansion in our model system provides proof of principle. The SSOs were then studied in FRDA patient-derived cells. In light of reports of sustained morpholino action in neuronal rescue models in the mouse (G41, G42), whether the effect from a single exposure to the SSOs could be sustained in post mitotic cells was examined.

A Single Dose of MLH3 SSOs Slows Repeat Expansion Over 4 Weeks in FRDA Fibroblasts.

FRDA patient-derived fibroblastic cells do not exhibit repeat expansion at the GAA•TTC repeats in the FXN gene under normal circumstances. However, ectopic expression of the DNA mismatch repair protein MSH3 will cause the GAA•TTC repeats to expand whether the fibroblasts are passaged and actively dividing, or confluent and not dividing (G1). MSH3 was expressed in FRDA fibroblasts via lentivirus transduction as has been done in the past, and then it was demonstrated that expansion by a one-time treatment with MLH3 SSOs can be reduced.

Figure 8:
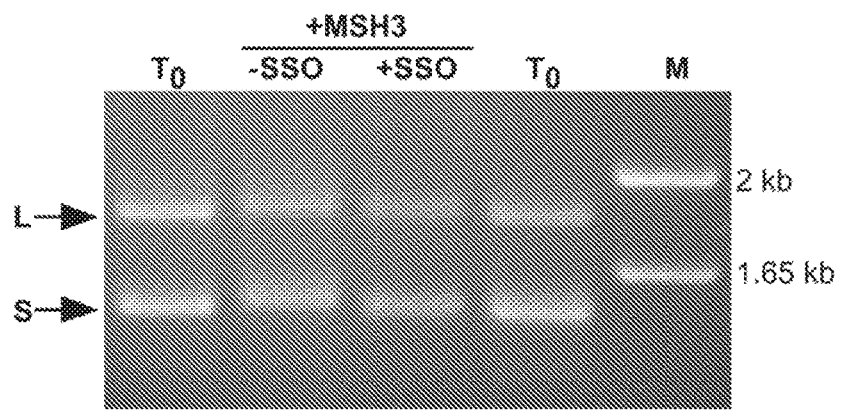
FIG. 8 is a photographic image of a gel showing that single treatment with MLH3 SSOs slows expansion in non-dividing FRDA cells. PCR products show long (L) and short (S) alleles from FRDA patient fibroblasts.

FRDA fibroblasts GM04078 (Coriell) were transduced with lentivirus expressing MSH3 at time zero ($T_0$). Transduced cells were plated at high density and allowed to reach confluence. At week 1, some cells were exposed to 750 nM SSOs (acceptor and donor) for 24 hours. After that, all cells were fed with normal growth media (DMEM+10% FBS). At 5 weeks post transduction (4 weeks post SSO treatment), DNA was prepared and repeats were sized with PCR. The results of one such experiment are shown in FIG. 8. Despite the small differences, it is apparent that the treated cells expanded less than did the untreated cells. The results of experiments such as this indicate that the SSOs used have a sustained effect on non-dividing cells, and this effect can be seen in as little as one month in culture. Such experiments also inform our power analysis for the planned mouse study.

Research

The "YG22" FRDA mouse model exhibits region specific GAA•TTC repeat expansion (G6). MLH3-specific splice-switching oligonucleotides (SSOs) will be used to block this expansion. MLH3 has recently been identified as a component of CAG•CTG expansion in the Huntington's disease "R6" mouse model (G5) and region specific CAG•CTG expansion in the same model has been linked to MSH3 (G2-G4). The parallels are considerable; without being bound by theory, MLH3 is key to GAA•TTC repeat expansion in the FRDA YG22 mouse, as well as in human FRDA cells.

However, whether the SSOs will penetrate where needed and whether the vivo-morpholino versions will cause clotting will be examined in mice. Therefore, SSOs will be tested in C57BL/6J mice before moving to the much longer experiments in the Tg(FXN)YG22 Pook mice.

The following will be tested: two types of SSO, two ages of application, and two delivery protocols in mice. Simple or "naked" morpholinos have long been used in model organisms, including mice, and have been in human trials for the past several years (G7-G9). Their safety and efficacy are well known. One drawback is the consistent penetration in adult tissue.

The conjugated "vivo-morpholino" is designed to have better tissue penetration in the mouse (G40, G43). Without being bound by theory, retrograde transport of vivo-morpholinos will get them into dorsal root ganglia. The vivo-morpholinos are superior for tissue culture compared to naked morpholinos (G41, G44).

Design and Test of MLH3 Exon Skipping SSOs in Mouse Cells.

The mouse MLH3 exon structure parallels that of humans. The SSOs and splice assay nucleotides needed will parallel those used for the human MLH3 locus, although they will have somewhat different nucleotide sequences.

C57BL/6J mice, the mice will be humanely killed and dissected after intervals (see Table 3 for numbers, dosing and intervals). RNA will be isolated from brain, cerebellum, dorsal root ganglia, heart, and liver, and will be assayed for MLH3 isotype via reverse transcription PCR (RT-PCR). Safety, tissue penetration, and persistence of action by high or low doses of naked morpholino and vivo-morpholino SSOs will be determined in both newborn and adult mice before any experiments in the "YG22" mice are conducted.

TABLE 3

Mouse distribution and end points in research protocol. DNA and RNA will be isolated from brain, cerebellum, dorsal root ganglia, heart and liver.

| Mice | Regimen | Reagent | Dose | Collection time points |
| --- | --- | --- | --- | --- |
| 66 wt mice C57BL/6J | Post natal day 0 (PND0) Cohort One-time injection | 12 vivo-morpholino 12 morpholino 12 control | 50 mg/kg 50 mg/kg Saline | RNA will be isolated at weeks 1, 2, 4 and 8 for splice switching efficacy RT-PCR assay (N = 3 for each time point & condition). |
| | Young adult Cohort Single injection at 8 weeks | 12 vivo-morpholino 12 morpholino 6 control | 50 mg/kg 5 mg/kg 50 mg/kg 5 mg/kg Saline | RNA will be isolated 1 and 2 weeks after injection for splice switching efficacy RT-PCR assay (N = 3 for each time & condition). |
| 96 "YG22" Transgenic mice carrying Tg(FXN)YG 22Pook | Post natal day 0 (PND0) Cohort One-time injection | 16 vivo-morpholino 16 morpholino 16 control | 50 mg/kg 50 mg/kg Saline | DNA & RNA will be isolated at 3 months (n = 8) and at 6 months (n = 8) |
| | Young adult Cohort Bimonthly injection starting at 8 weeks | 16 vivo-morpholino 16 morpholino 16 control | 50 mg/kg 5 mg/kg 50 mg/kg 5 mg/kg Saline | 8 DNA & RNA @6 months 8 DNA & RNA @6 months 8 DNA & RNA @6 months 8 DNA & RNA @6 months 16 DNA & RNA @6 months |

These reagents will be tested in mouse cell lines in culture, including cells from the C57BL/6 mouse, just as has been done with human MLH3. A small synthesis of vivo-morpholinos will be used for the tissue culture assays. Once mouse MLH3 isoform switching has been optimized, a larger synthesis of the vivo-morpholinos and the corresponding simple morpholinos will be ordered. When SSOs for the mouse are discussed in this example, either naked or vivo-morpholinos, it will most likely refer to a cocktail of donor and acceptor blocking sequences as shown in FIGS. 6 and 7.

SSOs that are effective for mouse MLH3 will be identified quickly. Confidence in the bioinformatic analysis of the MLH3 gene in mice, the design of the SSOs and the splice detection oligonucleotide pairs has been established.

Breeding of Mice During the Design and Testing Period.

B6.Cg-Fxn$^{tm1MKn}$-Tg(FXN)YG22Pook/J and C57BL/6J mice will be ordered from the Jackson Laboratory. The strain B6.Cg-Fxn$^{tm1Mkn}$Tg(FXN)YG22Pook/J is a double mutant: hemizygous for a human FXN locus with expanded GAA•TTC repeats and heterozygous for a knockout of the mouse FXN locus. Through selective breeding, mice homozygous for the human FXN locus, but lacking the knockout of mouse FXN, will be produced. Subsequent crosses with C57BL/6J mice will produce offspring bearing a human FXN transgene and normal mouse FXN alleles to avoid possible selection against repeat expansion due to insufficient frataxin.

Initial Testing of SSO Safety and Efficacy in C57BL/6 Mice.

It can be quickly ascertained in wild type mice whether the SSOs are safe and effective for MLH3 isotype switching. After a single injection of candidate SSOs in newborn (PND0, in facial vein) or adult (8 weeks, in tail vein)

Two Types of SSO and Two Delivery Protocols to be Tested in YG22 Mice.

A single application at birth (post natal day 0, PND0) will be administered via facial vein injection. Application of naked morpholino or vivo-morpholino SSOs at birth has been shown to penetrate into the central nervous system (CNS), possibly due to a leaky blood brain barrier at birth (G41, G42). For the PND0 cohort, a one-time injection will be followed by an interval of normal mouse rising with no further experimental manipulations until the mouse is humanely killed at the appropriate time point (see Table 3).

Bi-monthly application in adult mice, starting at 8 weeks will be administered via tail vein injection. The "YG22" cohort of GAA•TTC repeat bearing adult mice will get a tail vein injection every two weeks starting at 8 weeks before the mice are humanely killed at 26 weeks of age. Further, in adult mice we will test two concentrations of SSO, 5 mg/kg and 50 mg/kg (see Table 3 for distribution). A chronic low dose may be safer than a high dose, and these experiments will help determine if the low dose is sufficient to get into tissues such as the heart (G45, G46).

SSO efficacy will be assayed in two ways. The MLH3 isoform 1 to isoform 2 ratios will be measured via RT-PCR. GAA•TTC repeat length in "YG22" mice will be measured via PCR. Tissue from the CNS and PNS, as well as somatic tissues, will be further assayed.

Tissues to be dissected from mice for RNA and DNA isolation will include 1) brain, 2) cerebellum, 3) dorsal root ganglia (DRG), 4) heart and 5) liver. Tail DNA will also have been prepared separately for genotyping, and may serve as an additional control.

Without being bound by theory, reduced expansion in the cerebellum and DRG of PND0 injected YG22 mice will be observed. Without being bound by theory, persistent SSO activity will be observed in tissues containing long lived post-mitotic cells such as brain, cerebellum and heart, but less so in liver due to dilution by cell division.

Without being bound by theory, robust SSO activity will be observed in the livers of the young adult YG22 repeated high dose morpholino and vivo-morpholino cohorts, and a little less activity will be observed in the heart.

Without being bound by theory, little or no SSO activity will be observed in the heart and little activity will be observed in the livers of low dose morpholino YG22 adult cohort, but moderate to robust activity will be observed in the low dose vivo-morpholino YG22 adult cohort due to chronic accumulation of the vivo-morpholino.

Without being bound by theory, SSO activity will be observed in the DRG of vivo-morpholino, but not naked morpholino treated adults. If sufficient GAA•TTC expansion occurs in the DRG, an effect of SSO treatment, will be observed, particularly in the high dose vivo-morpholino cohort.

Without being bound by theory, reduced expansion will not be observed in the cerebellum or brain of the young adult YG22 cohort due to poor penetration of the blood brain barrier no matter the dose.

Statistics

Statistical analysis will predominantly use one-way or two-way ANOVA. We used power analysis to arrive at the number of animals for the study, based upon our ability to separate repeats differing by 1-2% of length. The transgenic repeat lengths detected by PCR will range between 1000 to 1300 base pairs (bp). FRDA patient derived cells we have worked with can gain 4 to 6 repeats (12-18 bp) a month. We assume that if the mouse cerebellar samples gain comparably, we should detect a 50% effect of the treatment in 2 months with 8 (morpholino) 8 (vivo-morpholino) to 16 controls for each injection/dosing condition with 80% power. If mouse GAA•TTC repeat expansion exceeds the human rate, we will have more power. Our long-term experiments should have a larger expansion differential producing more power and allowing for some dropout. The RT-PCR based mRNA splicing assay is more easily measured, has a large delta and requires a smaller "n" when not accompanied by the DNA repeat sizing assay. Hence the wild-type C57BL/6J mice used in early tests have reduced numbers compared to "YG22."

Example 3

Monitoring mice for long-term consequences of the treatments described in these examples can be done. The longest experiments will look at 6-month-old mice, well before even a complete knockout from birth would show an effect. Changing the ratio of MLH3 isoforms, not knocking MLH3 out, will be changed. Furthermore, morpholino oligomers are lost or diluted by cell division. Consequently, cells at risk for a cancer phenotype such as intestinal epithelia or lymphoblasts will only transiently be deficient in MLH3 isoform 1.

In one embodiment, the frataxin deficient phenotype of the Pook mice can be studied at a later stage. The mFXN knockout allele will be bred out to avoid potential interference with repeat expansion by a frataxin deficient phenotype. Here, frataxin replete Tg(FXN)YG22Pook mice will be used solely to examine repeat expansion.

As discussed in the preceding examples, SSO efficacy will be assayed in two ways: 1) the MLH3 isoform 1 to isoform 2 ratios will be measured via RT-PCR. This will be done in cultured cells, C57BL/6J and YG22Pook mice; and 2) GAA•TTC repeat length in YG22Pook mice will be measured via PCR (conventional and small-pool).

It will be determined whether morpholino SSO mediated MLH3 isoform switching can reduce the rate of GAA•TTC repeat expansion in the YG22Pook mice. Because morpholino SSOs only need to bind their target to abrogate splicing, an SSO or cocktail of SSOs effective in mice will be identified. Without being bound by theory, the most effective SSO or SSO cocktail found in tissue culture can be toxic to mice in the vivo-morpholino form, but the unmodified, or simple morpholino oligomers, will also be used as a backup. The simple morpholino SSOs will have reduced penetration in adult tissue. But, simple morpholino SSOs have been shown to be effective from a single PND0 injection in mice for at least 65 days (2) and are safe enough that several are in human trials (11-13).

Testing of the SSOs can be done quickly and relatively inexpensive in cultured mouse cells and wild-type C57BL/6J mice, while the YG22Pook mice are bred. Without being bound by theory, both immediate toxicity and the efficacy in MLH3 splice switching in C57BL/6J tissues will be determined in a matter of days. The longer time points are there to determine the staying power of the morpholinos in various tissues to determine the dosing regimen needs to be adjusted before starting long-term experiments in YG22Pook mice.

MLH3 isoform 1→2 switching is a direct measure of SSO efficacy. Consequent effects of a decrease in MLH3 isoform 1 on GAA•TTC repeat expansion rate will be measured via PCR across the repeat (both conventional and small pool PCR).

The mice available from Jackson lab are heterozygous for mFXN knockout and hemizygous for Tg(FXN)YG22Pook. Breeders will be developed with normal mFXN genes that are homozygous for Tg(FXN)YG22Pook for two reasons: (1) Breeding with C57BL/6J will produce offspring that are all hemizygous for YG22 so that mice can be efficiently treated at birth without wasting reagent or waiting for genotyping; and (2) Normal mouse frataxin expression will ensure that expansion of the repeat will not be counter-selected by frataxin insufficiency.

RT-PCR determination of MLH3 isoform 1→2 switching is a direct measure of SSO efficacy, and comparison of MLH3 isoforms to those in control tissues will be informative regarding tissue penetration of the SSOs.

Mice available through the Jackson Laboratory, which are heterozygous for mFXN knockout and hemizygous for Tg(FXN)YG22Pook, will be used. Breeders will be developed with normal mFXN genes that are homozygous for Tg(FXN)YG22Pook for two reasons: 1) Breeding with C57BL/6J will produce offspring that are all hemizygous for YG22 so that mice can be efficiently treated at birth without wasting reagent or waiting for genotyping; and 2) Normal mouse frataxin expression will ensure that expansion of the repeat is not counter-selected by frataxin insufficiency.

Without being bound by theory, the activity of the SSOs will diminish over a shorter time course in rapidly dividing tissues as the mouse grows and the SSOs will be diluted. Furthermore, cells that are post-mitotic at birth should retain SSOs and their activity far longer. For instance, Porensky et al. showed that a single injection of simple morpholino SSOs at birth lead to splice switching that remained robust in brain and spinal cord at 65 days (2). Consequently, there will also be sustained activity of PND0 administered SSOs in brain and spinal cord for at least 8 weeks. If the splice switching activity declines thereafter, the aggregate effects of diminished and partially diminished MLH3 isoform 1 expression on GAA•TTC repeat expansion at 3 months or greater will be able to be assessed.

The heart will be examined because it is an affected tissue in FRDA. Without being bound by theory, the working model will show that the repeat focally expands in heart leading to stochastic loss of fibers (along with their expanded repeats). Thus, it is nevertheless of great interest to determine whether therapeutic SSOs can be administered into the heart.

Changes in the rate of expansion will be assessed by comparing the rate of expansion in tissues that typically exhibit expansion with those that typically do not in YG22 mice. In addition, the rate of expansion will be compared in tissues from untreated littermates to tissues in the treatment groups. Conventional PCR has been shown to be sufficient to see gross changes in size in the YG22 repeat, particularly in the cerebellum (A14, A15). Small pool PCR will have to be used to assess more rare events in other tissues, as well as to simplify the smear obtained from expanded repeats seen with conventional PCR in the cerebellum (A16).

REFERENCES

A1. Summerton, J. and Weller, D. (1997) Morpholino antisense oligomers: design, preparation, and properties. *Antisense Nucleic Acid Drug Dev,* 7, 187-195.

A2. Porensky, P. N., Mitrpant, C., McGovern, V. L., Bevan, A. K., Foust, K. D., Kaspar, B. K., Wilton, S. D. and Burghes, A. H. (2012) A single administration of morpholino antisense oligomer rescues spinal muscular atrophy in mouse. *Human molecular genetics,* 21, 1625-1638.

A3. Morcos, P. A., Li, Y. and Jiang, S. (2008) Vivo-Morpholinos: a non-peptide transporter delivers Morpholinos into a wide array of mouse tissues. *BioTechniques,* 45, 613-614, 616, 618 passim.

A4. Ferguson, D. P., Dangott, L. J. and Lightfoot, J. T. (2014) Lessons learned from vivo-morpholinos: How to avoid vivo-morpholino toxicity. *BioTechniques,* 56, 251-256.

A5. Halabi, A., Ditch, S., Wang, J. and Grabczyk, E. (2012) DNA mismatch repair complex MutSbeta promotes GAA•TTC repeat expansion in human cells. *The Journal of biological chemistry,* 287, 29958-29967.

A6. Hienonen, T., Laiho, P., Salovaara, R., Mecklin, J. P., Jarvinen, H., Sistonen, P., Peltomaki, P., Lehtonen, R., Nupponen, N. N., Launonen, V. et al. (2003) Little evidence for involvement of MLH3 in colorectal cancer predisposition. *Int J Cancer,* 106, 292-296.

A7. Liu, H. X., Zhou, X. L., Liu, T., Werelius, B., Lindmark, G., Dahl, N. and Lindblom, A. (2003) The role of hMLH3 in familial colorectal cancer. *Cancer Res,* 63, 1894-1899.

A8. Lipkin, S. M., Moens, P. B., Wang, V., Lenzi, M., Shanmugarajah, D., Gilgeous, A., Thomas, J., Cheng, J., Touchman, J. W., Green, E. D. et al. (2002) Meiotic arrest and aneuploidy in MLH3-deficient mice. *Nature genetics,* 31, 385-390.

A9. Chen, P. C., Dudley, S., Hagen, W., Dizon, D., Paxton, L., Reichow, D., Yoon, S. R., Yang, K., Arnheim, N., Liskay, R. M. et al. (2005) Contributions by MutL homologues Mlh3 and Pms2 to DNA mismatch repair and tumor suppression in the mouse. *Cancer Res,* 65, 8662-8670.

A10. Chen, P. C., Kuraguchi, M., Velasquez, J., Wang, Y., Yang, K., Edwards, R., Gillen, D., Edelmann, W., Kucherlapati, R. and Lipkin, S. M. (2008) Novel roles for MLH3 deficiency and TLE6-like amplification in DNA mismatch repair-deficient gastrointestinal tumorigenesis and progression. *PLoS genetics,* 4, e1000092.

A11. Kinali, M., Arechavala-Gomeza, V., Feng, L., Cirak, S., Hunt, D., Adkin, C., Guglieri, M., Ashton, E., Abbs, S., Nihoyannopoulos, P. et al. (2009) Local restoration of dystrophin expression with the morpholino oligomer AVI-4658 in Duchenne muscular dystrophy: a single-blind, placebo-controlled, dose-escalation, proof-of-concept study. *Lancet Neurol,* 8, 918-928.

A12. Goemans, N. M., Tulinius, M., van den Akker, J. T., Burm, B. E., Ekhart, P. F., Heuvelmans, N., Holling, T., Janson, A. A., Platenburg, G. J., Sipkens, J. A. et al. (2011) Systemic administration of PRO051 in Duchenne's muscular dystrophy. *The New England journal of medicine,* 364, 1513-1522.

A13. Cirak, S., Arechavala-Gomeza, V., Guglieri, M., Feng, L., Torelli, S., Anthony, K., Abbs, S., Garralda, M. E., Bourke, J., Wells, D. J. et al. (2011) Exon skipping and dystrophin restoration in patients with Duchenne muscular dystrophy after systemic phosphorodiamidate morpholino oligomer treatment: an open-label, phase 2, dose-escalation study. *Lancet,* 378, 595-605.

A14. Anjomani Virmouni, S., Sandi, C., Al-Mandawi, S. and Pook, M. A. (2014) Cellular, Molecular and Functional Characterisation of YAC Transgenic Mouse Models of Friedreich Ataxia. *PLoS one,* 9, e107416.

A15. Ezzatizadeh, V., Sandi, C., Sandi, M., Anjomani-Virmouni, S., Al-Mandawi, S. and Pook, M. A. (2014) MutLalpha heterodimers modify the molecular phenotype of Friedreich ataxia. *PLoS one,* 9, e100523.

A16. Clark, R. M., De Biase, I., Malykhina, A. P., Al-Mandawi, S., Pook, M. and Bidichandani, S. I. (2007) The GAA triplet-repeat is unstable in the context of the human FXN locus and displays age-dependent expansions in cerebellum and DRG in a transgenic mouse model. *Human genetics,* 120, 633-640.

Example 4

Exploring DNA Mismatch Repair Complexes Involved in Repeat Expansion.

Friedreich ataxia (FRDA) is a progressive neurodegenerative disorder caused by GAA. TTC repeat expansion in the first intron of the frataxin (FXN) gene. Disease severity correlates to the length of the expanded repeats and the reduction of FXN mRNA. The mechanism of repeat expansion is not yet completely understood; however, it has previously been shown that the expansion rate is associated to transcription within the repeats. Without being bound by theory, DNA repair enzymes are attracted to structures formed within the GAA. TTC repeat during transcription and the subsequent actions of these repair enzymes then promote the expansion process. It has been shown that shRNA knockdown of either MSH2 or MSH3, components of mismatch repair complex MutSβ, slowed GAA•TTC expansion in the model and FRDA patient fibroblasts. Furthermore, ectopic expression of MutSβ induced GAA. TTC repeat expansion in the native FXN gene. Other components of DNA mismatch repair complexes are being examined to elucidate their role in FRDA (for example, see FIGS. 2A-B and FIG. 3 for MLH1, MLH3, and PMS2 data). For example, components of the heterodimeric complexes in mismatch repair's human homolog MutL are of interest, which participate in the repair of a subset of mismatches, recognized by the MSH2-MSH3 complex. Due to alternative splicing and alternative AUG start codon usage there are many possible variations in MutL complexes (See FIG. 9B). Without being bound by theory, only a few particular isoforms of these complexes are responsible for repeat expansion. Presently, these components of DNA mismatch repair are being examined in order to elucidate their role in FRDA and discover possible therapeutic targets, exploring the role of MLH3 isoforms in FRDA repeat expansion. The heterodimer of MutL Homologue one (MLH1) with MLH3 forms the necessary MutL complex, which is known as MutLγ. MLH3, a component of the MutLγ complex, has 2 isoforms due to alternative splicing. MLH3 isoform 1 (MLH3 iso1) has exon 7 and MLH3 iso2 lacks exon 7 (FIG. 9B). Exon 7 contains the endonuclease domain. Without being bound by theory, excluding exon 7 can approximate a functional knock out if MLH3 is critical to repeat expansion. The expression levels of the spliced variants were correlated to the GAA•TTC repeat expansion rate in a human cell model.

Detecting MLH3 Isoforms 1 and 2.

To study the functional diversity of MLH3 protein isoforms, the altered expression levels of the spliced variants were measured to evaluate their effects on GAA•TTC repeat expansion. Primer pairs, MLH3 L3324 and MLH3 R3757, resulted in a 434 bp band for MLH3 iso1 and a 362 bp band for MLH3 iso2. A 16.6% difference allowing for visualizing the presence or absence of the 72 nucleotide long exon 7. Dilutions of defined isoform templates containing or excluding exon 7 were done in 10:1, 1:1, and 1:10 respectively to demonstrate the quantitative nature of this PCR (FIG. 9A).

Forcing Exon Choice.

Splice switching oligos (SSOs) were designed to mask the acceptor and donor regions of MLH3 exon 7 to induce skipping of exon 7 and the consequent production of MLH iso2 (FIG. 5).

RT-PCR Demonstrates Exon Skipping.

100 nM and 500 nM dilutions of acceptor, donor, and a combination of both SSOs were given twice a week to FRDA model cells to examine the effect of MLH3 SSOs on MLH3 isoforms. The control received media only. Cells were assessed for MLH3 isoform variant expression with RT-PCR using the designed primer pair (FIG. 6). The control resembles the 10:1 (MLH1 iso1:MLH3 iso2) ratio of defined templates of known concentration shown in FIG. 9A. The combination of acceptor and donor SSOs caused the effective exclusion of exon 7.

MLH3 Iso1 Required for Expansion.

PCR analysis of GAA•TTC expansion was conducted at week 3 with 100 nM and 500 nM dilutions of acceptor, donor, and a combination of both SSOs to examine the effect of MLH3 SSOs on MLH3 isoforms. Repeat growth assay PCR product equals 500 bp flanking sequence plus 3x's number of repeats. Sample 6 with 500 nM of both acceptor and donor SSOs slowed expansion (FIG. 7). Sample 4 with 500 nM of the donor SSO also had a slowing effect but not as substantially as the combination of the SSOs (FIG. 7).

MLH3 contributes to GAA•TTC repeat expansion in human cells. Specifically, MLH3 exon 7 is necessary for GAA•TTC repeat expansion in human cells. Lack of exon 7 slows GAA•TTC repeat expansion in FRDA model cells. The endonuclease domain of MLH3 is needed for this effect.

Targeting both the splice donor and acceptor region of exon 7 excluded MLH3 iso1. Such a method as splice skipping can have potential as a future therapeutic avenue for FRDA. In one embodiment, MLH3 is useful as a therapeutic target to slow the progression of repeat expansion disorders such as Friedreich ataxia. On another embodiment, small molecule directed skipping of MLH3 exon 7 is a useful therapeutic approach.

Future studies will include: (1) Observation of intrinsic expression of MLH3 variants iso1 and iso2 in different cell lines, including FRDA patient cells; (2) Observation of variants in the CNS and heart tissue; and (3) Explore MLH1, which has 22 isoforms, and is the MutLγ partner of MLH3.

Example 5

The core innovation of this technology is a therapeutic oligonucleotide for the treatment of DNA repeat expansion diseases, which include Friedreich ataxia, ALS, and Huntington's disease, among others. This innovation will likely be given orphan drug designation, highlighting a commercialization strategy associated with a number of commercial benefits.

Friedreich ataxia (FRDA) is a progressive neurodegenerative disorder caused by GAA. TTC repeat expansion in the first intron of the frataxin (FXN) gene. Disease severity correlates to the length of the expanded repeats and the consequent reduction of FXN gene expression. While the mechanism of repeat expansion is not fully understood, it has been shown that the expansion rate is associated with transcription within the repeat (FIGS. 1A-F) and requires the action of MutSbeta and a MutL complex (G1, G2). The necessary complex is MutLgamma, a heterodimer of MLH1 and MLH3 (see FIG. 1E). MLH3 expression is key to DNA repeat expansion in human cells. MLH3 is expressed in humans as two isoforms. MLH3 isoform 1 includes exon 7, while MLH3 isoform 2 lacks exon 7 (FIG. 5). Skipping exon 7 leaves MLH3 isoform 2 intact, and does not impact the cellular ratios of MLH1 and its binding partners PMS2, PMS1 and MLH3. Splice-Switching Oligonucleotides (SSOs) described herein directed skipping of MLH3 exon 7 and slowed GAA•TTC repeat expansion in this model system, and is proof of principle as a therapy (see FIGS. 6-7).

Currently there is no effective treatment and no cure for any of the many DNA repeat expansion diseases. The core innovation of this technology aims to markedly shift the therapeutic focus from purely symptomatic to one that directly tackles the underlying disease mechanism. By slowing the expansion rate of the disease-causing DNA repeat, this therapeutic aims to slow the progression of the disease and extend a high quality of life for the individual.

Without being bound by theory, the approach targets a central mechanism that is shared by a number of repeat expansion diseases. Therefore, it has the potential to treat many, if not all of the diseases in this class. The gene-specific exon skipping in Duchenne muscular dystrophy (DMD) is more limited; SSO mediated exon skipping in DMD can only treat a fraction of the DMD patient population (G3-G5). Nonetheless, at least two startup companies (Sarepta Therapeutics and Prosensa) have been formed around exon skipping in DMD. Diseases that can benefit from this technology include Friedreich ataxia, ALS (c9orf72), Huntington's disease, Fragile X syndrome, Myotonic dystrophy Types I and II, Spino Cerebellar Ataxias (SCAs) currently including SCA1, SCA2, SCA3, SCA6, SCA7, SCA8, SCA10, SCA12, SCA17, SCA31 and SCA36 among others.

Explanation of Specific Experiments and Concepts to be Proven

The mismatch repair protein MLH3 is key to GAA•TTC repeat expansion. This minor component of MMR will be developed as a therapeutic target to limit repeat expansion in FRDA patients, and all repeat expansion patients. The SSOs used are the same type already in human trials for Duchenne muscular dystrophy (G3-G5). The work shown in FIG. 6 and FIG. 7 were carried out using the "tandem reporter" model system (G10).

The work will be expanded upon, verifying it in primary patient cells, adding additional disease causing repeats to the "tandem reporter" expansion model such as CAG•CTG (DM and the polyglutamine disorders), CGG•CCG (fragile X) and CCGGGG•CCCCGG (ALS due to C9ORF72), and designing and testing additional SSOs to achieve greater efficacy. The approach will also be studied using a mouse model of Friedreich ataxia repeat expansion, as discussed in the Examples herein.

MLH3 Splice Skipping Stops Repeat Expansion in Patient-Derived Cells

FRDA patient-derived cells do not exhibit repeat expansion at the GAA•TTC repeats in the FXN gene under normal circumstances. However, ectopic expression of the DNA mismatch repair protein MSH3 can cause the GAA•TTC repeats to expand (G2). MSH3 works upstream of MLH3 in a minor arm of mismatch repair (see FIGS. 1A-F). MSH3 will be expressed in target cells as has been done in the past, and then it will be demonstrated that the repeat can be stopped from expanding by treating the cells with MLH3 specific SSOs. Friedreich ataxia patient cells gain an average of 1 repeat a week, so after 6 to 8 weeks of continuous culture. Without being bound by theory, a positive result in the repeat size profiles of the collected DNA, as in the "tandem reporter" model (FIG. 7), will be observed.

Myotonic dystrophy (DM1) patient-derived cells will be obtained from the Coriell cell repositories, and ectopic expression of MSH3 will be used to encourage the repeats to expand as outlined in Halibi et al (G2). The long CTG•CAG repeats in the DMPK gene of DM1 are fairly unstable in patients. Expansion will be detected, although the exact time course is not yet known. A recent publication on a mouse model of DM1 suggests that the rate of CTG•CAG expansion in mouse cells (G11) exceeds what we found for GAA•TTC in FRDA patient-derived cells. However, the bona fide DM1 patient-derived cells may expand more slowly, so the cells will be cultured for 60 to 120 days before collecting DNA.

Fragile X syndrome patient and carrier-derived cells will be obtained from the Coriell cell repositories, and ectopic expression of MSH3 will be used to encourage the CGG•GGC repeats to expand as outlined in Halibi et al (G2). Several mouse models of Fragile X syndrome have been developed (G12,G13) and PCR techniques incorporating 2M to 3M betaine are known (G12) that will get through these templates to size the repeats accurately after 60 to 120 days of continuous culture.

Repeat Tracts Representative of Repeat Expansion Diseases of Interest into Tandem Reporter Cell Lines Will be Cloned to Test MLH3 Exon Skipping Most of the repeat expansion diseases do not have suitable patient derived cell lines with which to perform expansion studies. The rapid expansion system with a repeat cloned between tandem reporters expands GAA•TTC repeats at a rate ten- to twenty-fold faster than the patient derived cells that have been enhanced with MSH3 expression (G2). The cell lines are permissive for GAA•TTC expansion. Therefore, tandem reporter constructs will be made as have been done previously for GAA•TTC tracts (G1) using the serial ligation method previously developed (G14). Huntington's CAG•CTG lines, DM1 CTG•CAG lines, Fragile X CGG•CCG lines and ALS CCGGGG•CCCCGG lines will be generated. The techniques for making the cell lines are routine in the inventor's laboratory (e.g., G1 and G14 describe the processes in detail, which are herein incorporated by reference in their entireties).

Generation of these additional disease model cell lines will demonstrate the generality of the expansion model to other repeat expansion diseases. Comparing the rates of expansion of these various repeats in an identical environment will go far in elucidating the underlying mechanisms. The rapid expansion system with the tandem reporter carrying various disease specific DNA repeats may be desired as discovery platforms by companies seeking to develop additional therapies for repeat expansion.

Design and Test of Additional SSOs to Optimize MLH3 Exon Skipping

The results shown in FIG. 6 indicate that while the initial choices for acceptor and donor SSOs are very effective in combination, there is room for improvement. This is particularly true for the acceptor blocking SSO. New SSOs will be designed, particularly at the acceptor site, to improve efficacy. Safety and efficacy studies will also be performed in a mouse model of Friedreich ataxia GAA•TTC repeat expansion. Several sets of mouse-specific SSOs will be tested to optimize mouse MLH3 exon skipping. The data obtained from the mouse studies will inform the search for a better human set of SSOs.

Goals

Demonstration of the efficacy of MLH3 exon skipping in bona fide FRDA patient cells will be conducted. Cell lines will be obtained, grown for 60 days plus or minus ectopic MSH3 and SSOs, and subsequently will performing the RT-PCR assays on the MLH3 splice isoforms and the PCR reaction to determine repeat lengths.

Goals will be: Preparing the plasmids for the in vitro constructions. Selecting for the site-specific integration of the constructs, amplifying the cells in tissue culture and then assaying the initial size of the repeats before freezing the cell lines in liquid nitrogen. If the patient derived cells for myotonic dystrophy or Fragile X syndrome do not produce results, the corresponding repeat will be used in the rapid expansion system with the MLH3 SSOs to provide the data.

REFERENCES

G1. Ditch, S., Sammarco, M. C., Banerjee, A. and Grabczyk, E. (2009) Progressive GAA•TTC repeat expansion in human cell lines. PLoS genetics, 5, e1000704.

G2. Halabi, A., Ditch, S., Wang, J. and Grabczyk, E. (2012) DNA mismatch repair complex MutSbeta promotes GAA•TTC repeat expansion in human cells. The Journal of biological chemistry, 287, 29958-29967.

G3. Kinali, M., Arechavala-Gomeza, V., Feng, L., Cirak, S., Hunt, D., Adkin, C., Guglieri, M., Ashton, E., Abbs, S., Nihoyannopoulos, P. et al. (2009) Local restoration of dystrophin expression with the morpholino oligomer AVI-4658 in Duchenne muscular dystrophy: a single-blind, placebo-controlled, dose-escalation, proof-of-concept study. Lancet Neurol, 8, 918-928.

G4. Goemans, N. M., Tulinius, M., van den Akker, J. T., Burm, B. E., Ekhart, P. F., Heuvelmans, N., Holling, T., Janson, A. A., Platenburg, G. J., Sipkens, J. A. et al. (2011) Systemic administration of PRO051 in Duchenne's muscular dystrophy. The New England journal of medicine, 364, 1513-1522.

G5. Cirak, S., Arechavala-Gomeza, V., Guglieri, M., Feng, L., Torelli, S., Anthony, K., Abbs, S., Garralda, M. E., Bourke, J., Wells, D. J. et al. (2011) Exon skipping and dystrophin restoration in patients with Duchenne muscular dystrophy after systemic phosphorodiamidate morpholino oligomer treatment: an open-label, phase 2, dose-escalation study. *Lancet*, 378, 595-605.

G6. The New Economics of Orphan Diseases. *Genetic Engineering & Biotechnology News*, Jan. 1, 2013.

G7. The Economic Power of Orphan Drugs. *Thomson Reuters*, 2012.

G8. Top 20 orphan drugs by 2018. *FiercePharma*, Jul. 23, 2013.

G9. Global Market for Orphan Drugs is Expected to Reach $112 Billion in 2017. Drugs.com, August 2013.

G10. Banerjee, A., Sammarco, M. C., Ditch, S., Wang, J. and Grabczyk, E. (2009) A novel tandem reporter quantifies RNA polymerase II termination in mammalian cells. *PloS one*, 4, e6193.

G11. Gomes-Pereira, M., Hilley, J. D., Morales, F., Adam, B., James, H. E. and Monckton, D. G. (2014) Disease-associated CAG.CTG triplet repeats expand rapidly in non-dividing mouse cells, but cell cycle arrest is insufficient to drive expansion. *Nucleic acids research*.

G12. Lavedan, C., Grabczyk, E., Usdin, K. and Nussbaum, R. L. (1998) Long uninterrupted CGG repeats within the first exon of the human FMR1 gene are not intrinsically unstable in transgenic mice. *Genomics*, 50, 229-240.

G13. Entezam, A., Biacsi, R., Orrison, B., Saha, T., Hoffman, G. E., Grabczyk, E., Nussbaum, R. L. and Usdin, K. (2007) Regional FMRP deficits and large repeat expansions into the full mutation range in a new Fragile X premutation mouse model. *Gene*, 395, 125-134.

G14. Grabczyk, E. and Usdin, K. (1999) Generation of microgram quantities of trinucleotide repeat tracts of defined length, interspersion pattern, and orientation. *Analytical biochemistry*, 267, 241-243.

G15. BioMarin buys Prosensa for up to $840M, shoots for quick OK of Duchenne drug. *FierceBiotech*, Nov. 24, 2014.

Example 6

Summary

Without being bound by theory, the GAA•TTC repeats that cause Friedreich ataxia (FRDA) continue to grow in length over time in the tissues that are affected by the disease. Without being bound by theory, this is what causes the gradual onset of Friedreich ataxia, and also what causes its progressive nature. Data indicate that this continued expansion of GAA•TTC repeats requires transcription through the repeat then the sequential actions of several DNA mismatch repair proteins called MutSbeta (MSH2/MSH3 heterodimer) and then MutLgamma (MLH1/MLH3 heterodimer). Transcription is the process of copying the double stranded DNA into RNA so that protein can be made. Subjects, such as humans, need transcription of the frataxin gene. However, during transcription of the GAA•TTC repeat, the repetitive DNA can become misaligned. A small loop in the misaligned DNA can be mistaken for a mismatch by MutSbeta, which binds it, and then attracts MutLgamma. MutLgamma is the protein complex that cuts the DNA in the repeat to start the expansion. Without the cut, there is no expansion. One small part of MLH3, called exon 7, is the knife that does the cutting. In people there are two forms of MLH3, one carries the knife (exon 7), one does not. As described herein, compositions and methods designed to skip exon 7 have been identified, using splice-switching oligonucleotides (SSOs), so that little or no MLH3 carries a knife. The repeat stops expanding in cells that are treated with SSOs. The mouse MLH3 gene (mMlh3) is like that of humans (hMLH3). There is a mouse model of FRDA called "YG-22" that shows tissue specific GAA•TTC repeat expansion. As described herein, testing SSOs to block this expansion in mice serves as a first step heading to human trials.

First, the mouse MLH3 gene was targeted with a panel of SSOs specific to the mouse. This experiment was completed, and the SSOs were tested for efficiency of splice switching in mouse cell lines. The mouse cell lines that were initially used turned out to express little mMlh3, which made the experiments difficult and time consuming. Subsequently, a number of mouse cell lines were tested to find ones that were more like neurons. One of these neuron-like cell lines expressed sufficient mMlh3 to determine that an SSO pair flanking the knife exon of mMlh3 would work much like the human SSOs for hMLH3. Subsequent experiments tested these SSOs in the mice. The first hurdle in the mice was a safety concern. In rare cases that are sequence-specific, SSOs can clump together and cause a blood clot in mice. Initial tests in mice demonstrate that this has not happened, and that the morpholinos were all well tolerated. Subsequent, tests will show how well these SSOs are at splice switching mMlh3 in different mouse tissues and organs, and also the ability of the SSOs to slow repeat expansion in FRDA model mice.

MLH3 is expressed in humans as two isoforms, MLH3 isoform 1 and MLH3 isoform 2, due to alternative splicing. MLH3 isoform 1 includes exon 7, which contains a conserved endonuclease domain, while MLH3 isoform 2 lacks exon 7. It was recently determined that the MLH3 isoform 1 is required for GAA•TTC expansion, while isoform 2 is not. Skipping exon 7 by use of SSOs effectively shifts MLH3 to isoform 2 and stops repeat expansion in human cells. Finally, skipping exon 7 leaves MLH3 isoform 2 intact, so the SSOs will not impact the total cellular ratios of MLH1 and its binding partners PMS2, PMS1 and MLH3.

Forced Exclusion of the Exon Coding for the Mouse MLH3 Endonuclease Domain, as Well as Neighboring Exons as a Backup.

Figure 11:
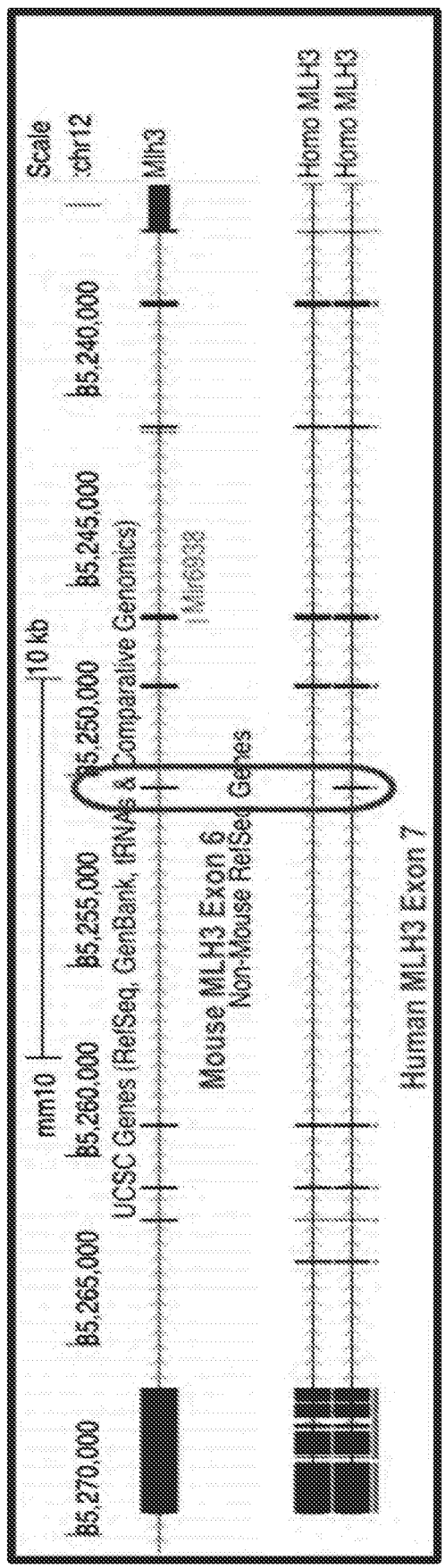
FIG. 11 is a UCSC Genome Brower image illustrating concordance of mouse and human MLH3 gene structures. The red oval indicates the variable exon in hMLH3 that is missing in hMLH3 isoform 2. This variable exon contains a conserved endonuclease domain.

The mouse MLH3 exon structure parallels that of humans except that the endonuclease domain is contained in exon six rather than exon seven. In FIG. 11 this exon is circled in red to highlight it. Although mouse MLH3 is not reported to have isoforms lacking this exon, the exon is 72 bases long, and skipping it leaves the downstream exons in the same translational reading frame just like human MLH3 isoform 2. Consequently, without being bound by theory, it was anticipated that the SSOs targeting this exon to produce results like we found in hMLH3.

Figure 12:
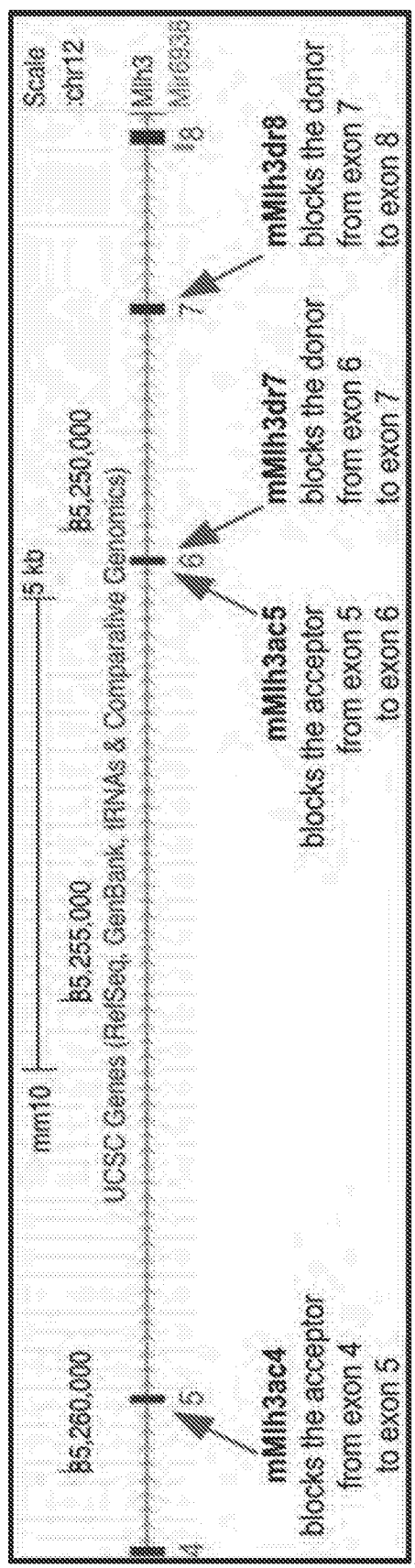
FIG. 12 is a schematic illustrating that splice switching oligonucleotides target a subset of mMLH3 exons. SSOs function by tightly binding pre-mRNA at splice junctions thereby excluding splicing factors.

Due, in part, to the lack of reported mMlh3 isoform 2 homologues, other exons were also targeted in order to have several viable candidate SSOs to put into the mouse. This provides a backup: 1) in case mMlh3 exon 6 was not as easy to skip as hMLH3 exon 7 and 2) as mentioned in the original grant, the literature indicate that rare adverse effects of vivo-morpholinos may be mediated by sequence-specific interactions of the morpholinos that cause them to aggregate in the bloodstream (1). Consequently, the initial strategy was to target exons 5 and 7 as well as exon 6 in the mouse MLH3 pre-mRNA. The graphic in FIG. 12 serves to visualize that strategy. Optimally, each SSO would serve to exclude the exon it targets, however, in practice a range in efficacy has been identified in the case of human MLH3, and the same is expected in mice. Previously experiments demonstrate that using a pair of SSOs was more effective than a single SSO at the same total morpholino concentration (see FIG. 6 and FIG. 7).

Primary fibroblasts derived from the C57BL/6 mouse were originally proposed to be used to test the SSOs. Part of the reasoning for using an isogenic line was to avoid the possibility that private point mutations in a cell line would interfere with results. Unfortunately, the primary fibroblasts expressed little mMlh3, making the determination of splice switching much more difficult than it had been in the HEK293 cells used in human experiments. NIH3T3 cell line was used, as this cell line might work better. The primary and transformed mouse fibroblastic cells gave similar, if not presentable, results, allowing for decisions to be made about SSO efficacy and excluded the mMlh3 exon 7-targeted SSO mMlh3dr8 from further consideration.

Without be bound by theory, the ability to study repeat expansion and hMLH3 isoforms in HEK293 cells was aided by the neuronal nature of the HEK293 line (2,3). Therefore, after working with fibroblasts, mouse cell lines with a neuronal nature were sought for future experiments. A mouse neuroblastoma cell line called Neuro-2A (4) expressed sufficient mMlh3 for us to complete the testing of the candidate SSOs. For example, experiments such as that shown in FIG. 13 were used to refine doses in order to look at possible synergies between the SSOs. In general, the SSO treatments resulted in the discrete fragments predicted.

Figure 13:
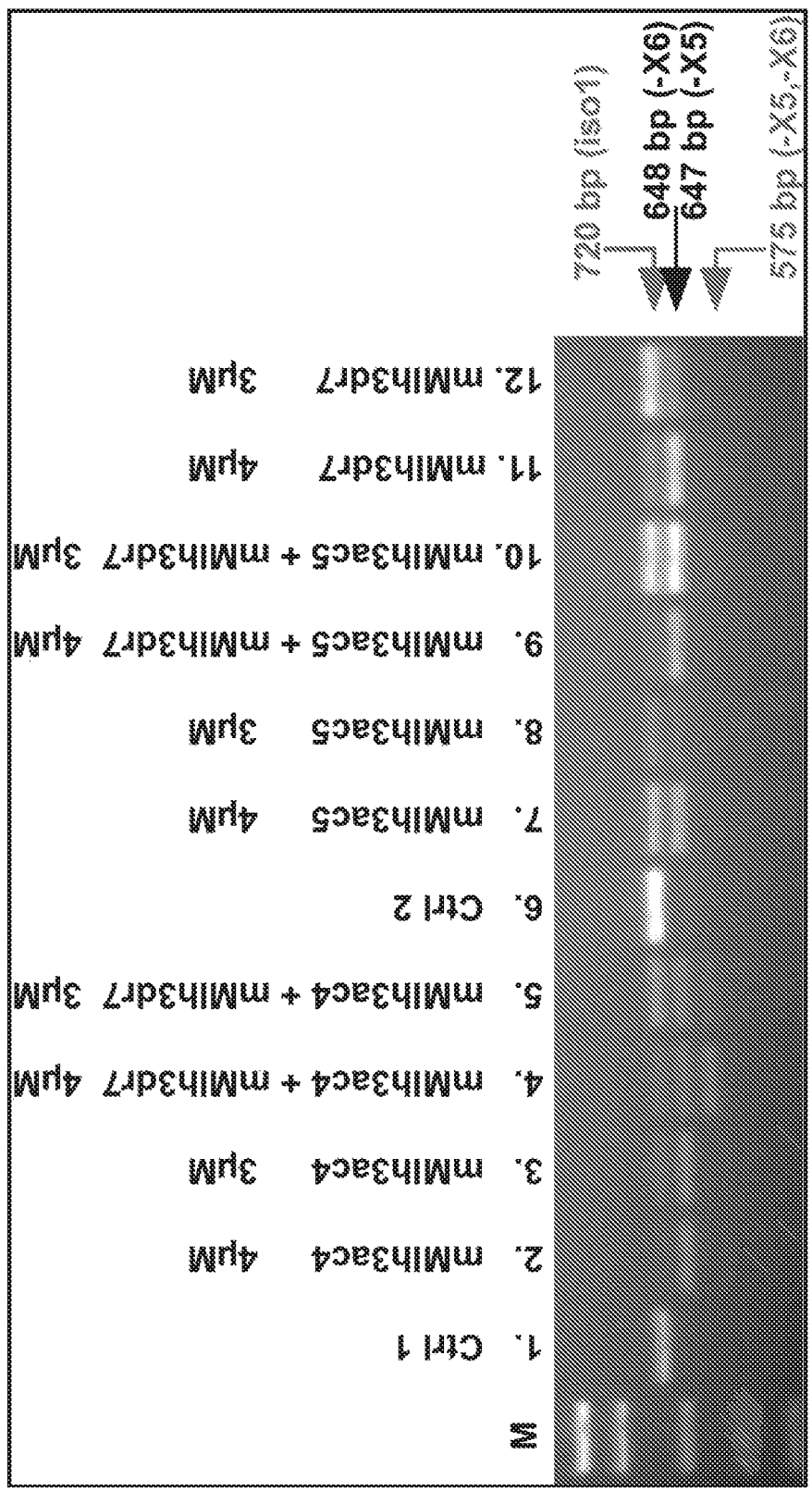
FIG. 13 shows individual and paired SSO activity in mouse Neuro-2A cells. Cultured cells treated with the indicated morpholino oligomers at the indicated concentrations were lysed after 48 hours and RNA was isolated for cDNA synthesis. PCR analysis of the cDNA using oligonucleotides flanking the region of interest in the mMlh3 mRNA resulted in specific bands corresponding to no skipping (720 bp), skipping exon 5 or exon 6 (~648 bp), or skipping both exons 5 and 6 (575 bp). Lane M is the 1 Kb plus DNA ladder showing bands of 1000, 850, 650, 500 and 400 base pairs.

For instance, in lanes 4 and 5 in FIG. 13, there are 3 bands corresponding to the 4 possible fragments indicated to the right of the gel image. The bands within each lane are fairly quantitative relative to one another because they are in competition for the same primers, but we did not control for loading between lanes. However, the consistently lower yield of products with use of mMlh3ac4 was verified with real-time PCR quantification of mMlh3 message. Without being bound by theory, this reproducible several fold reduction was related to nonsense-mediated decay due to the frame-shift caused by loss of the 73 base long exon 5. In contrast, skipping exon 6 leaves the reading frame intact.

Although the morpholino mMlh3ac4 was more effective than any other single morpholino in reducing the amount of full-length mMlh3 mRNA, it was not used in mice for several reasons. First, and foremost, the combination of SSOs mMlh3ac5 and mMlh3dr7 produced a reliable switch to the mouse equivalent of hMLH3 isoform 2. This pair has the dual advantages of closely mimicking what will be accomplish in FRDA patients, and not causing degradation of the mMlh3 mRNA, so that the ratio of the isoforms can more readily be detected. In contrast, use of mMlh3ac4 complicated the assays because of the degradation of mMlh3 exon 5-skipped mRNA. In mouse fibroblasts, the products became difficult to detect.

Morpholinos can Sustain mMlh3 Splice Switching in the Mouse.

Figure 14:
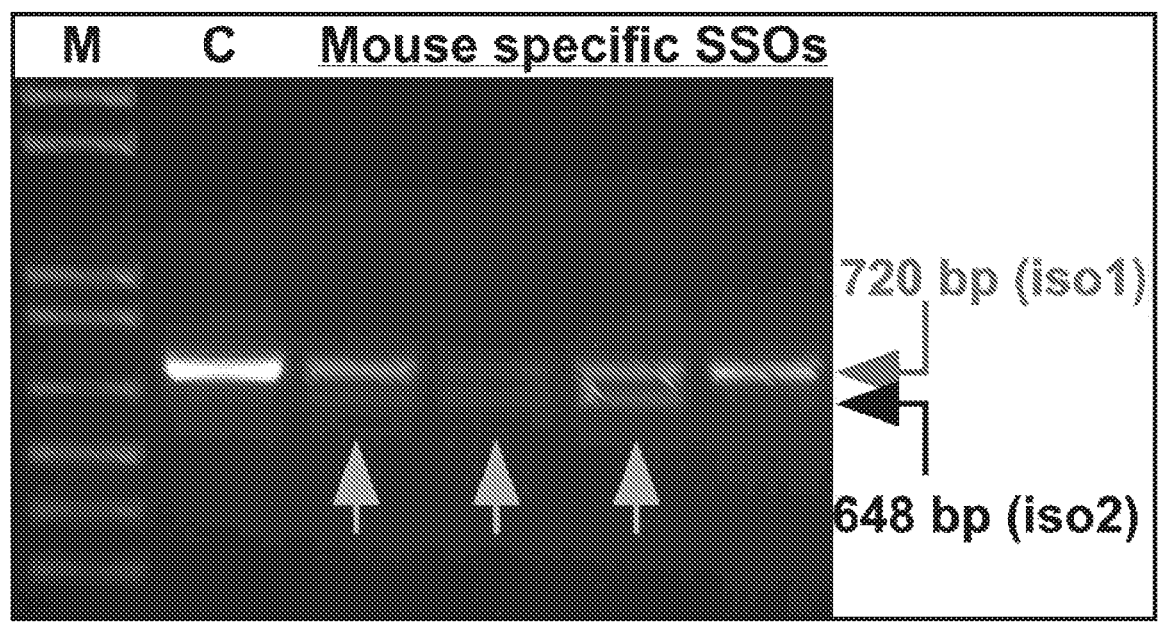
FIG. 14 shows Mlh3 exon skipping is evident in adult mice 48 hours after a single injection. Adult C57BL/6J mice were given a single dose (5 μg/g) of a mixture of mMlh3ac5 and mMlh3dr7 cell penetrating "vivo" morpholino SSOs in the tail vein. Tissues were collected after 48 hours and RNA was isolated to identify the splice variants. In this experiment, 3 of 4 mice injected with SSOs exhibited the desired mMlh3 exon skipping in kidney (green arrows). Controls (C) were injected with saline.
Figure 15:
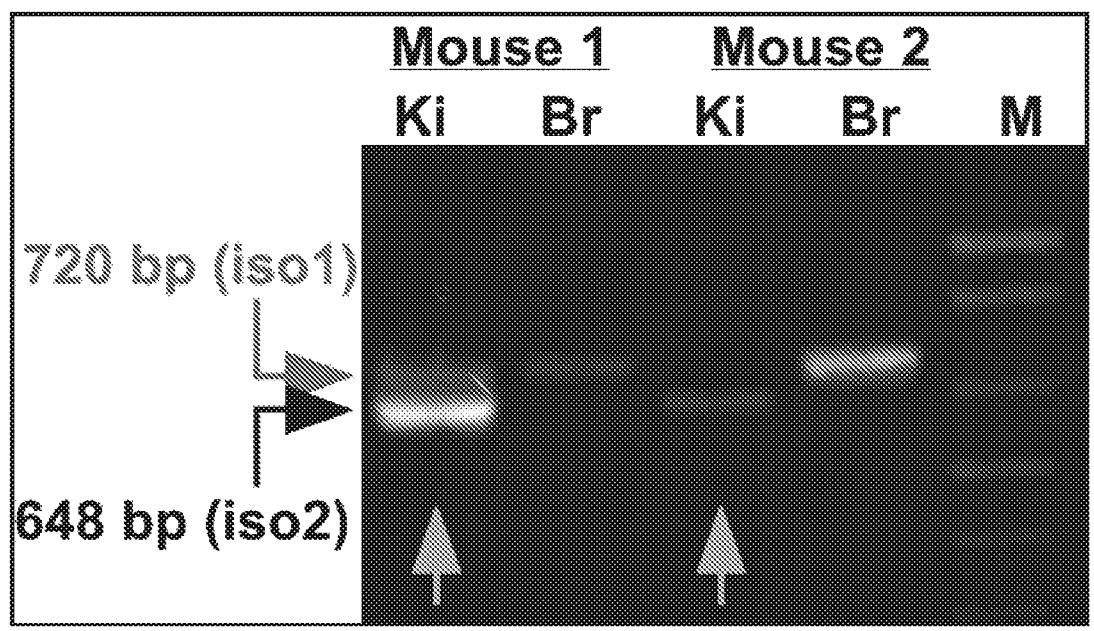
FIG. 15 shows Mlh3 exon skipping is robust in adult mice 48 hours after a single high dose injection. Adult C57BL/6J mice were given a single dose (50 μg/g) of a mixture of mMlh3ac5 and mMlh3dr7 cell penetrating "vivo" morpholino SSOs in the tail vein. Tissues were collected after 48 hours and RNA was isolated to identify the splice variants. In this experiment, 2 of 2 mice injected with SSOs exhibited robust mMlh3 exon skipping in kidney (green arrows). In these mice the treatment did not penetrate the blood brain barrier and mMlh3 remained as isoform 1 in brain (Br).

The FRDA mouse model work is underway and results demonstrate that the mouse versions of the SSOs penetrate tissue and change the mouse MLH3 splicing pattern (FIG. 14). Ongoing studies in the mouse model will track and correlate the expansion of FRDA repeats over time to provide proof of therapeutic efficacy, which will enhance pharmaceutical interest. The results of a test for splice-switching activity in C57BL/6 mice are shown in FIG. 14.

Injection of Higher Doses of In Vivo Morpholinos in Mice Demonstrate No Noticable Adverse Reactions.

A rare, but serious side effect was the possibility that one of the In Vivo-morpholinos would clump and cause a toxic clot in the animals. In the literature, such an adverse event is usually fatal within a few minutes (1). Such a reaction is more likely at a dose above 12 µg/g. So far, no mice have exhibited such adverse events at even 50 µg/g.

The higher dose was more effective, switching a relatively greater fraction of the mMlh3 to isoform 2. Coupled with the lack of adverse events, future experiments will use the higher dose. Finally, because current formulations do not cross the blood brain barrier, the SSOs will be injected directly into brain for future experiments.

Murine SSO Sequences Tested in this Example

| Identifier | Oligo name | Nucleotide Sequence |
|---|---|---|
| SEQ ID NO: 45 | mMlh3ac4 | GAACCTGCGATTCACGGAGATAAGT |
| SEQ ID NO: 46 | mMlh3ac5 | TCCACCTACAAAATAATCCAGGATT |
| SEQ ID NO: 47 | mMlh3dr7 | AACTACAGACAGATACTTACCAGTA |
| SEQ ID NO: 48 | mMlh3dr8 | CATGTCCTCAGGCTACTGACCGTAA |

Murine Mlh3

The *Mus musculus* mutL homolog 3 (Mlh3) gene comprises approximately 36,126 bp contained within the genomic region (GRCm38/mm10) Assembly chr12:85,234,466-85,270,591. The chromosomal location of murine Mlh3 is Accession No: NC_000078.6.

The two major murine Mlh3 variants (mMlh3) comprise:
1) *Mus musculus* mutL homolog 3 (Mlh3), transcript variant 1, mRNA NCBI Reference Sequence: NM_175337.2
2) *Mus musculus* mutL homolog 3 (Mlh3), transcript variant 2, mRNA NCBI Reference Sequence: NM_001304475.1

The two major human Mlh3 variants comprise:
1) RefSeq: NM_001040108.1 *Homo sapiens* mutL homolog 3 (MLH3), transcript variant 1, mRNA.
2) RefSeq: NM_014381.2 *Homo sapiens* mutL homolog 3 (MLH3), transcript variant 2, mRNA.

REFERENCES CITED IN THIS EXAMPLE

1) Ferguson, D. P., Dangott, L. J. and Lightfoot, J. T. (2014) Lessons learned from vivo-morpholinos: How to avoid vivo-morpholino toxicity. BioTechniques, 56, 251-256.
2) Graham, F. L., Smiley, J., Russell, W. C. and Nairn, R. (1977) Characteristics of a human cell line transformed by DNA from human adenovirus type 5. The Journal of general virology, 36, 59-74.
3) Shaw, G., Morse, S., Ararat, M. and Graham, F. L. (2002) Preferential transformation of human neuronal cells by human adenoviruses and the origin of HEK 293 cells. The FASEB journal: official publication of the Federation of American Societies for Experimental Biology, 16, 869-871.
4) Olmsted, J. B., Carlson, K., Klebe, R., Ruddle, F. and Rosenbaum, J. (1970) Isolation of microtubule protein from cultured mouse neuroblastoma cells. Proceedings of the National Academy of Sciences of the United States of America, 65, 129-136.

EQUIVALENTS

Those skilled in the art will recognize, or be able to ascertain, using no more than routine experimentation, numerous equivalents to the specific substances and procedures described herein. Such equivalents are considered to be within the scope of this invention, and are covered by the following claims.

SEQUENCE LISTING (48 sequences)

SEQ ID NO: 1 - DNA, 44769 bp, Homo sapiens
gatcatttgagcctgggaggttaaggctgcaataagctgtgactgtgccaccatccttcagaaaaaaaaaagaaaaaggaaaagaggtattgacaattcacattcatgtttcaaagattccttccaggttagaatttgaattttaagtaccacagtcccaggaatgagacacttatttttcatttttattttttagctttagttttagtatgaggataatgctggcttaataaaatgtgttgggaagtgtttcctcttcttttttttaacccttaattcttggtttggatcttcttctattttttggaagagtttgtgaagggttggtaaaggatttttttttaaacatttggtagaatttacccatgaagccatctggtcctgggctttttatctgtgggaagtttttgattacaaattccatctcttggtataggtctattcagactttctatttcttcttgattcagttttggttgtttgtctttctaggtattaggtttgttttcatccaaaaaaatttaatctaattttttggcatataattgttcatagaattcccttttatcctttttatctttgtaaggttggtggtaatgtctccttttatttctgattttagtaatttgaggctttcatccgtttttctttatcagtctagctaaaggttgtcaattttgttgatcctgtcaaagaagcaacttttgttttattgattttctctattcttctgctttccattaatttctgctctaatctttatttccttctttctgctcattttgaattcagtttgctcttctttttctagtatcctaaggtggaaatcttgattattgatttgaagagagtttctttttagattgcaactagaggtggtgattacagtccttgaaatgttgtcagatgattgtttaagcaaaaatatggttatgaggtagaattcactttttggaattttcttaggggagaaaaaccctgttggtgcaatagatattcaaaactgaacatgagtcaataacattatgtcatcattaaaaaaataagaacagagttgagcacacaaatgaaaccagtaggaaacgcccattctcaacactggtcaaattttggagtgttctgttcaactctcaagagttcagataaggccaggtgcagtggctcatgcctgtaatcccagcactttgggaggccgaggcaggcggatcatgaggtcaggagatcgagaccatcctggctaacacagtgaaaccccatctctactaaaaatacaaaaaaattagccgggagtggttgcgggcgcctgtggtcccagctactggggaggctgaggcaggagaatggcataaacctgggaggcggagcttgcagtgagctgagatcacgccactgcactccagtctgggcgacagagcgagactccgtctcaaaaaaaaaaaaaaaaaaaaaaaaagagttcagataaatcacattgcaaatttttaaagatttatttgactgtgacaacctcctgtttaaaactgcacattcttacagctatttaccatataagataactcttaagaactggagatagtcagctcccctgggttaatttgaagcagaagagggcagttgttatactgccctgtcagttggatgcggagtcttactcaaaattcattctcagcattcttcttttatggtatcttctttggcacttagcagcgcatcaggtaggcatcttctatttttcttcattccttaatttcctttgtatccctcaaatggttatttatttggctggagtctgttttgttcattaagcaaacatgtctttgctttgaacatgtctttgatttgatggatacttaaattcctcatcaaacattttgttgctatgcataacgttttctttggccaactccagcaatttcccacattttgacatgcaatcatgttaactcccattttcttttgtaatccaacatcttctatttagataattactttaacaatcaatgacttaatattctaatcataaatttatacaaaaataaaattacctccaaaacattgctacctttcctaaacattcagtcttgccacagtttaataaaaggaaagaacattaaaaaggataagacactgtaatgattagatgctttttataagcctaaaggcattgtgattatttagacagaagagaagaaagtgaagtgaaaacctgatagttatgtagtctcatggtttgctgttgagaggctgaacaccagctgctttccttttctaggaagataataaagtgggctttggctacaacataaagatgttgggttagacagtttcactacagtaagaacaacgggatgagttgcccaggaaattgtgaaatactttctaatgatctttaaagatataatgaacactaattcatctggatttgtttacgtgtggtcctggttaaaggcaaagggaaggatcagataacttcatgttttttccatttaacatacccaatagattcttgattaggggaagggaaaatgagcaagatacagtccagtattctaaaaacaatcagccttaggggatcatttcaaaagcatctgttttggacttaagtctttgatacttaaccaaattgactacacagtgaaaaattctagtgcctgggttttatagggtagaagaaagacatgcagtcaagtggccaatacttcatgtgaagataagcaatgagatccttcttgctgtctttcttttgactgttctgggcaatatcaaattagtttcagtggcttgattctaggccaagattctggcaacagattgtagtcttaccttgttttcttcaatctcactggatctctctctctttttaccccccttaggctgagggtaaaaagctgggattggtaggctgggtccagaacactgaccggggcacagtgcaaggacaattgcaaggtcccatctccaaggtgcgtcatatgcaggaatggcttgaaacaagaggaagtcctaaatcacacatcgacaaagcaaacttcaacaatgaaaaagtcatcttgaagttggattactcagacttccaaattgtaaaataatggcctgaatttaagttttctaagataaactcagtggtttggtttttattattaatagagatagaactattgtgtgttaatattagcattagtcaataagttattttaatgtcagatttttgaatgttattatatattacctgtatgatggaaggattaccactgtacacaaatctaatcaataaaaacgttagaaccttctgcttagagtacttttaaaaaatcttcagtgaacttccttttgggcgaaatgagaggtctttattcagtaaacatttgtaggaagaggattttgaggtaatttaaagaggtctgaaagaaaaaaagtctgagtcatttctttaaatggtttctatgaaatgttcttcaagaaattccatgcctaataagaacaaataccacaagttcaatttgttagctctgttcaccttatgtttggatgaattacttctgctgttgtttcttttctctgggtaaggaattcacataaagttatgttatgggctgaactgtgtcccaccaaattcatatgttaaagtctcagtccccagtacctcagaaagtgactgtatttggacatagggcctttaaagaggtgattaagattaaatgaggctgtgagggtgggccctaatccaatctgactggtgttcttataagagaacatattggctatagacacgtgtgcaaaaatcaaagaccctgtgaaaatggccatctacaagccaaggagagaggcctcaggagaaatcgttgctgccaacaccttgatctcagacttccagtctctagaactgagaggaaatagacttctgctgcttaagctactcagtctgaggtattttgttatggcagccctaggtatagtaataatcataaacagttatcaggattttgcttaatcagccctagaagactggttggttgggtttggttagtcactaaactagcatatatcaaatgcttaccaggtctgacaaattcgttataaattccactttaaattctcaatgaaaatgagatagaaagcaaaaactaaggactggttaacaattccaaaacactttattctcacagcattctcagagttctgctctcctttagttatttttataactaaaagctgtggtggcactggggagattcaagtcagtgaagagagtcttggtgttgtcatctgtaaattaagagttgagcaaaggccgggtgcggtggctcacgcctgtaatcccaacactttgggaggccgaggcgggcagatcacctgaggtccggagttcgagaccagcctgaccaacatggagaaacccccgtctctactaaaaatacaaaattagccgagtgtggtggcgcatgcctgtaatcctagctactcgggaggctgaggcaggagaatcacttgaaccctggaggcggaggttgcagtaagctgagatcgcaccactgaattccagcctgggcaacaagagctaaactccgtctcaaaaaaaaaaaaaaaaaaaaaaagagttgagttagacagtttctcagccttttccagctccaaatgccataattctaagatggcaggctctggaattattcattcattcggtgcctaccataggccaggcactgttcttggtaactgggatacagcagtaaacaaaatatataaactccttaccttcacatagcttacattctagggagagaagacaataagtaaacacataaaatatatattgaattaaacggtagttaagagcaaaggtgaaaatgagaaaaaaaaggaaagggaaaacacgggaaaaaaaaataaaaacaaaagtaaaagctacgacatagtctttaacaccatgccaaaagggaataaggattgagactgtaggtaccggttcactgaaccctgggatgcggatccttggctggaacaactggtgcgcatgcgcactggtgtctcgcggcctggcgcgccccctccgaagcgcatgctcgtgggcacgcacgagcctcaagatccaaggtgcgcgcgtcggcgtccgaggcggttggtgtcggagaatttgttaagcgggactccaggtgactctgggggaagcacgcgacgaaaagatgatgccggggtctcttctaacaccagaagggccctgatgatggctgcgcgcagctttcggagccggatgcgcgagggccccggaggcccggcggcctggcggccgggcgggcccagtttggggacaaggacggggctggccagggaggggctgggcctggcgggaaggcagcgctgccccggactcggcccgcgcggccctcccaggcccccgtgccctggatccaggcccgtgcgtcccgtcagtcccaggcgctgggaggcgtcatcaggaaatcattgggtttacattaatcggaatacttgttaaacgtttacccgtcagttgctgccggctgcttagtgcattagcttagaaagcagcagaaattctgcagttaagagccctgatttgtcccgagtttggaaaaccggccccaccgcctgcaggggcccacccacgtggctctcactgatggagaagaaggggagacctttaatggcactggaatcttagggtttggttttttttgttttgttttttgtttttgtgttttcacttgcaggaaaacttaaaatcaagttcaggcagccccatgccatcattattattaccaaggtagtttatgcccatctgtaaagaccaaaagaatattaataatgaccttctggccgggcgcggtggttcacacctgtaatcccagcactttgggaggccaaggcgggaggatcacttgagttcaggagttcgagaccaggctggttaacatggtgaaaccccatctctacataagagacaaaaattagccaggcatggtggcgagcgcctgtaatcccagctactcgggaggctaaggctggaggattgcttgagcccgggaggtgcaggctgcagtgagccgagattgtgtcattgcactccagcctgggtgacagagtgagactgtttcaaaaaagaataataacgactttctaaaaacatcagagtaatacatgaacaggatttaacaatcaaatggcaaagaaaggtttatatgaaaaggaattttcctgctttatcttttcccattcccagcctctttccctgaggtgactatacttaaccataataataataacctcttaatgcccccaatctctctttgatacaatttgattcttaaaatttcttcctattgcttcaccttattacaatgtcttagcaattcattataagtatttttctaaaagtcatggttattgtgtaatgtataaatgttatgaaactagcttggacatttttgtcatgaataatttctagctaatgttccttagctgtatttaatttaggcatctgtttttggtgaagtggttagaatttcgaatactgtgtttactggtcaacttcaagtgtaattatgatttcactttaggacatgtgggatttagaaaggagcattgaaaattatgaaattatgaattttttttggatgttaatccattgcaccaagcatgagctgtgcctagagatcagcggtataactttgttttgctttgtttcacaatttggtttaataagagtgatttcatttacctcaagtgctatttcttcataatgctgtgtaatgctaaagctttgattatgtgcgtgtgtggtttttttctccaataggcaattatttccagtcagagaaggaaaccagtgcctggcattctcaccatctttctacctaccatgatcaagtgcttgtcagttgaagtacaagccaaattgcgttctggtttggccataagctccttgggccaatgtgttgaggaacttgccctcaacagtattgatgctgaagcaaaatgtgtggctgtcagggtgaatatggaaaccttccaagttcaagtgatagacaatggatttgggatggggagtgatgatgtagagaaagtgggaaatcgttatttcaccagtaaatgccactcggtacaggacttggagaatccaaggttttatggtttccgaggagaggccttggcaaatattgctgacatggccagtgctgtggaaatttcgtccaagaaaaacaggacaatgaaaacttttgtgaaactgtttcagagtggaaaagccctgaaagcttgtgaagctgatgtgactagagcaagcgctgggactactgtaacagtgtataacctattttaccagcttcctgtaaggaggaaatgcatggaccctagactggagtttgagaaggttaggcagagaatagaagctctctcactcatgcacccttccatttctttctctttgagaaatgatgtttctggttccatggttcttcagctccctaaaaccaaagacgtatgttcccgattttgtcaaatttatggattgggaaagtcccaaaagctaagagaaataagttttaaatataaagagtttgagcttagtggctatatcagctctgaagcacattacaacaagaatatgcagtttttgtttgtgaacaaaagactagttttaaggacaaagctacataaactcattgactttttattaaggaaagaaagtattatatgcaagccaaagaatggtcccaccagtaggcaaatgaattcaagtcttcggcaccggtctaccccagaactctatggcatatatgtaattaatgtgcagtgccaattctgtgagtatgatgtgtgcatggagccagccaaaactctgattgaatttcagaactgggacactctcttgttttgcattcaggaaggagtgaaaatgtttttaaagcaagaaaaattatttgtggaattatcaggtgaggatattaaggaatttagtgaagataatggttttagtttatttgatgctactcttcagaagcgtgtgacttccgatgagaggagcaatttccaggaagcatgtaataatattttagattcctatgagatgtttaatttgcagtcaaaagctgtgaaaagaaaaactactgcagaaaacgtaaacacacagagttctagggattcagaagctaccagaaaaaatacaaatgatgcatttttgtacatttatgaatcaggtggtccaggccatagcaaaatgacagagccatctttacaaaacaaagacagctcttgctcagaatcaaagatgttagaacaagagacaattgtagcatcagaagctggagaaaatgagaaacataaaaaatctttcctggaacatagctctttagaaaatccgtgtggaaccagtttagaaatgtttttaagcccttttcagacaccatgtcactttgaggagagtgggcaggatctagaaatatggaaagaaagtactactgttaatggcatggctgccaacatcttgaaaaataatagaattcagaatcaaccaaagagatttaaagatgctactgaagtgggatgccagcctctgccttttgcaacaacattatggggagtacatagtgctcagacagagaaagagaaaaaaaaagaatctagcaattgtggaagaagaaatgtttttagttatgggcgagttaaattatgttccactggctttataactcatgtagtacaaaatgaaaaaactaaatcaactgaaacagaacattcatttaaaaattatgttagacctggtcccacacgtgcccaagaaacatttggaaatagaacacgtcattcagttgaaactccagacatcaaagatttagccagcactttaagtaaagaatctggtcaattgcccaacaaaaaaaattgcagaacgaatataagttatgggctagagaatgaacctacagcaacttatacaatgttttctgcttttcaggaaggtagcaaaaaatcacaaacagattgcatattatctgatacatccccctctttcccctggtatagacacgtttccaatgatagtaggaaaacagataaattaattggtttctccaaaccaatcgtccgtaagaagctaagcttgagttcacagctaggatctttagagaagtttaagaggcaatatgggaaggttgaaaatcctctggatacagaagtagaggaaagtaatggagtcactaccaatctcagtcttcaagttgaacctgacattctgctgaaggacaagaaccgcttagagaactctgatgtttgtaaaatcactactatggagcatagtgattcagatagtagttgtcaaccagcaagccacatccttaactcagagaagtttccattctccaaggatgaagattgtttagaacaacagatgcctagtttgagagaaagtcctatgaccctgaaggagttatctctctttaatagaaaacctttggaccttgagaagtcatctgaatcactagcctctaaattatccagactgaagggttccgaaagagaaactcaaacaatggggatgatgagtcgttttaatgaacttccaaattcagattccagtaggaaagacagcaagttgtgcagtgtgttaacacaagatttttgtatgttatttaacaacaagcatgaaaaaacagagaatggtgtcatcccaacatcagattctgccacacaggataattcctttaataaaaatagtaaaacacattctaacagcaatacaacagagaactgtgtgatatcagaaactcctttggtattgccctataataattctaaagttaccggtaaagattcagatgttcttatcagagcctcagaacaacagataggaagtcttgactctcccagtggaatgttaatgaatccggtagaagatgccacaggtgaccaaaatggaatttgttttcagagtgaggaatctaaagcaagagcttgttctgaaactgaagagtcaaacacgtgttgttcagattggcagcggcatttcgatgtagccctgggaagaatggtttatgtcaacaaaatgactggactcagcacattcattgccccaactgaggacattcaggctgcttgtactaaagacctgacaactgtggctgtggatgttgtacttgagaatggtaagtacgtagtattcatgtgcatgagatgcttttgaagatgggaatgctggacaaggagtaagatcctcattatccaaagagattatctcaacagatagaacattttgaagaccacttataaaacatatgttgtattttcatgctatatgaagatttgctacgtccaacactacttttttttttttttttttttgagacggagtcttgctctgtcacccaggctggagtgcagtggtgcgatctcagctcactgcaacctctgcccccctggttcaagcgattctcctgcctcagcctccagtgtagcttggattacaagagcatgccaccatgcccagctaaatttttttattttcagtagagacaggatttcactatgttggccaggctggtctcaaactcctagcctcaagtgatccacctgcctcggcctcccagagtgttgggattataggtgtgagcccgcacgcagcctctaggtccaacactatttaaatggagaagtacagtgaaaggatgtcagtgtgtgtatatgtgtctatgggtgtgtgtatgtgtaagaaagggggtgatgggtatatacctagagcaacaacaaaaggggtgagactgtccaattttaataaaaatgatactattaatagttgggaagatccacagtactttcctaccttgttttcccttcctgttaaatgcccagctttcctagaaatgtgtctttaaaggcacctgcagtgtcagcatggtattttactggaagtttctctgcgtggcttccaggttaagggccagaatgattctgtaatcatcctaggtttcccagtaaactctatggcttagtacagtactacatttatgagctttttctttctagaaagtaggacttgtccatgaattttcaaaatataggtcaagtatatactttcatgactatacttttcaaatgtactttattataatgcatatggtaaaatctccttgatgtgtttatggtacaagtagctgttattcaggaagacaataatatggcatttatttatttgagacagagtttcactcttgttgcccaggctggagtgtagtggcgtgatctcggctcactataacctccgcctcccaggttcaagggatcctcctgcctcagcctcccaagtagctgggattacaggcacccgctaccacacccggctaattttttgtgtttttgtagagacagggttttaccgtgttggccaggcttgtctcgatctcctgacctcaggtgatccacctgcctcggcctcccaaagtggtgggattataggcgtgagccactgcacccaaccaatatagcttttagatcgtaccacagggctacattagagcctgcactaggactctgggttctcggtccacatttaaagtgatattgctttggcagtgtgttgagagccagatgttgggaggtgataaagctgatttccatctggctataatcttggctttgcactaggaggataaacattacatctgtatccgtatttaaaattttgaatgctgcagaagaatggaacatgtataaatgtagttataagtcaatttctaatttctcctgacgatgaatatctctagcagaaagctgtggtttctttaaggttaaatgaaacctttacttttcagtgtttttctgtttttccttgtgaaaaaaaaatcactgtagtaacttcagtagtatttcatagtattttgtagtattcattaggagaaaactcatttctttcactgttgttcctgagactatcaagttgctcttaaagccactttatgtgcttttcaatctatgtggttttatgtcctgacttacactgaaggcttttcagaggtaaatctacagcactgacacctcatcttcctgaaatgcaactgcttctgatatggtgccaaaaaataactggattacattatactgtgagatggctgttgctaaaagaaagggggaaatcttagctgccatattcaacgtaaatatttcttccttttgaatatagacgtttaaaacactttaacctacttaacattctggattagcatacttttttatgaacttttgagggtcatgttaactgatagtttcctaatgaaaaatatttttggtatagaaagaagttccatgaacagatggctcctcagtaccctgctacctttctggaaatggctgatatacatcatgacatcaggacattgtcaaactttacataaaagtgttacatgaaataaattgttaaaagacaattttttttttttgagacggagtttcgctcttgttgcccaggctaaagtgaaatggtgcgatctcggctcactgcaacctccgccttctgagttcaagcgattctcctgcctcagcctcctgagtagctggaattacaggcatgcgccaccatgcctggctaattttgtatttttagtagagacgggatttctccatgttggtcaggctggtctcaaactcccaacctcaggtgatctgcccgcctcggcctcccaaagtgctgggattacaggcgtgagccaccagcctaaaagatacattttaatgtacagaaggaggatctataaaggtgattttgaggagtagtgtcaagtccccaagccttggtaattttttctttaaaatatattttatgcagttctttctattgtagttataaaccttatttcacttcattatcttaattttatcattcttaacctctccaggtttagtccaacagatttatctctcatgttttcctcctgttctaaagctgtcaaattcagcattgtttctaaaactcaaatctgattatccttcatggagaagaacagcatttgggccagatcttactagactctggagtttgaattgagaacctttcatttgtctacctgttcactttttcatgcagcatttgttgatcatccacactgtgctaggtgctgtcacgttgcaggttaactgactttgcttttaggagttcacagtactattagggaagatagctatctaaatataattgtattataatgagacaaatgttaggatagagacatacattggagataagagacataagttggagatttgtgaaggttgcaccaagttatggctgacaagtactgctgtatgtctaacacagggcttctctgggtaattttttgttgtaaggtttgtcctatgcattgtagaatatttagcagcatccgtggcctttatctgctagatgctagtagaacgtagaaccctttactcaagttgtgacaatgaaaagtgtctcaagccgggcacagtggctcacgcctgtaatcccaacactttgggaggccgaggcgggtggatcacaaggtcaagagtttgagaccagcccggccaatatggtgaaaccccatgtctactaaaaatacaaaaaaattagccgggtgtggtgacgcatgcctgtaatcccagctactcgggaggctgaggcaggagaattgcttgaacccgggaggcggaagttgcagtaagccgagatcacgccactgtactccagcccgggcgacagagcgagacgccgtctcaaaaaaaaaaaaaagggtctcaagacattgccaatgtcccctcgtgcaaaattgccccccagtgagaatcacagtgacctattctaggtcttcattctgtctggtatgaatagataatggaactaagcattaatatagagtcctatatggacagcataatttcattaaaggatttctgattctcaatctagtgtttagtagtctgctttatgtcttgactcagtttgtgcagaaagaggttttatgtgattaaatttttaaagagtttacttgtattttaagttcacatttctaggtttttctttcttatatttagggtctcagtacaggtgtcaaccttttagaagcgaccttgttcttcctttccttccgagagctcgagcagagaggactgtgatgagacaggataacagaggtaagggtggcagagagtgctggggcacacagtacacatcgtaccacctaactcaaaaaacaaagcaggcttgcattaagcttgatcagtgccagctgtgctgtactggaatcaggaattccccacggccctgtttaacagcggaactaattaattcagcgcatgcatttaggtcagaaattacttttccagacttgaggtcaatatttgctgattatgcatagtctgtggtgtcttgtgattaggggacatgtttcttatttttaaaaaggctggacttgcactccaagttgctgtagttttatgtaagcaaaactcttcaaaaaaagctacagacatcaattttgtgtgtatgtttaaaaatagataaggtatattttgcttaaaggcagtaaggctataaatttgagccatagcttctctgtcagtattccacaatatctcttttaacagtttggagaaaagctgtaatgccagaagatacagtcaccaactctagtttaaaaagtaacagatcaaaataatttagagatacagcaaacactgaacatttgtagaacatagaaacaatgtacgtgacctttggtcttgaggctatggctcaccaaacaggaaatgccattccctcctttccctgtggttctggatgccaactttacctgttcccttttgccctagatactgtggatgatactgttagtagcgaatcgcttcagtctttgttctcagaatgggacaatccagtatttgcccgttatccagaggtgggtctgtagcagtttttctttgccttttttttttcttcttcttcttcttattttttaaattttgagatggagttttgctcctgttgcccagactgaaatgcaatggcatgatctcggctcacgtaaccttcgcttcccaggttcaagcaattctcctgcctcagtctctcgagcagctgggattacaggcacctgccaccacgcccagcgaattttgtatttttagtagagatggggtttctccatattggtcaggctggtctctaactcccaacctcaggtgatctgcccgcctcagcctcccaaagtcctgggattacaggtgtgagccatcacgcccagcctttctttgcctgttattttaaactttgagtttcaagatgggtacagtggcatgcacttatagtctcagctactcaggaggctgaggtgggaggatcacttgaggccagaagttcaaggctatatagtgtgctgattgcacctgtgactagccactgcacactatagcctgggcaacacagtgagactccatctcttaaaaaataagtaaattagttaaaaataaaatttgaattttatttaagctgggtatgggcatgcaagactatattaatttgtaattatgattggaaactgggcatatttccaaattatgtatttggaaattactgtttaatgtagaggggagaaataaaatttatagcatttgggaactcaggcattttggattaaacatgtataatcaatgtgagaacagtgaatgtgtttaccactctcagaaaccctgacttgtagctttggcacagtattcagggtggtgataatgaaattgttatcattagataaagccacacatcttctactggaggaacagttcctcattggccccgcatggatgttctctcctcagtgtattttcacagaatgtactgtgcatgttataaacagggtgtataatagatgagcatttgtttaccagttctttcctcaagatatcatttgaggacttgatcatggaacatagacaaattgttgttgtgaaacaattttttttgttttgtcagtaattttgtttataagcaaaaatttttatgtaagactcattattcataaattcttttgaatttttttttttttttttttttttttttttttttttgtgacagagtcttgctgtgtcgcccaggctgaagtgcagtggcgtgatctcagctcactgcaagctccgcctcccgggttcacaccattctcctgcctcagtctcccaagtagctgggactaaaggcgcctgccgccacgcccagctaattttttgtattttttagtagagatggggtttcaccatgttagccaggatggtctcgatctcctgacctcgtgatctgcccgcctcagcctcccaaagtgctgagattacaggtgtgagccaccacgcccggccgattcttttgaatttctataaattccctgaattaaacccacctctagtaggctaaataaaaatgaatgcttttaaagcactctgatatctttggtaaaacaattctgacacaaaaattaaaatttcaattatattttgctgagtctttctaggttgctgttgatgtaagcagtggccaggctgagagcttagcagttaaaattcacaacatcttgtatccctatcgtttcaccaaaggaatgattcattcaatgcaggtaaaagattaacttcaaaatctcataaatatatatatatatatatatatatatatatatatatggcctaactcttctaaaatttgatttatttaatgatatagaccaccttggtcaaggcacgtgtgtgtgtgtgtgtgtgtgtgtgtgttcttactagaacttttatcatcagaagaaaaagcaagggattaattataattacaaagaaagaaatatctttagtagtgtaagtaggtttggagggaatgaattatggattcaggctgacagtttcaaggattctcaaggttctcctgcagaagattatatattgactttatatttggcaataatttataaatcaaagtcctttagtgaccttgtccttaagtgtgcaacagtgcccttttagaaattaccttctattgtgtgagcctacacaggtttgggaaagcccatattgagaagtcatttcacaaaagggaccctttgtctgatctgcttttctattttgccttgtgtttaccaccatggctgtcttattccctttgttttcagtacggaaacaaattaggaggctaacaaatttgggtaaactcctaacctggcattgacctggtaccagagcaggcaagcagttgatccagaaatagaccctggggcagtggtataggctcgggggtattggagagcctcaagtacctagacagagaggaaccaccaaggtctaaagccaccagtggcttttaacttacttctttaatagactagcagccgggcgcgctggctcacgcctgtaatcccagcactttgggaggccgaggtgggtggatcatgaggtcaggagttcgagaccatcctggctaacacggtgaaaccccgtctctactaaaaatacaaaaaattagctgggcgtggtggcgggcacctgtactcccagctactcgggaggctgaggcaggagaatggcatggaggcaggagaatggcatgaacccaggaggcagagcttgcagtgagccgagatcacaccattgcactccagcctgggtgacaaagtgagactccgtctcaaaaaaaaaaaaattaaaaataaataaaaataaaaatagactagtttctccataatcgttttccttgctttcatataaattttaaaaatttatttcagcctgtatgttagcaatctctggtcacattacctattctcaagagtcactctgttgggaacatctcaggccttctctaaagtattgctagcacaccactctgagacgtgggagtctgtcttcccctgtcgcctccctccccttacatcttctgatcaactccacctgcccattctttcatccttcctagtgactttttctggttcatcagaaccttacccagtctcaaagaaaggagtgtgataaggcaaacaactctaaataaaatacagttctgtatctttctatgcaaataagcctttgttaatttttatttagtgttgtaccacttatttgaatgtctgacaggttctccagcaagtagataacaagtttattgcctgtttgatgagcactaagactgaagagaatggcgaggcaggtaagaatggagtttagcctgaatgattaaccagctggtcttcttgtaacctttttttaatgattatttttggtatataatatagtttcaatgatttggatggattagggaaagccaatctaaaactaagaatattatgaaggctgggtgcggtggctcacacctgtaatcccaacactttgggaggtgaggcaggtggatggcttgaggccaggagttcaggaccagcctgagcaacatggcaaaaccccgtctctactaaaaatacaaaaattagctgggcatggtggtgtgcacctgtagtcccagctactcaggaggctaaggcacaagaatcgcttgaacttgggaggcagaggatgtagtgagccgagattgcgctattacactccagcctgggcgacagacatttagttttatgttcatacacatacatatactcaggatgcacattaaactatcaagagtatttactttgggagtgaaaatgagggtgtgcaaaggagatatttcaacttttactctttttgtcttttttttttcctttttgtggagaacggggtctcgctatattgcccaggtaggtctcgaactcctgggcttaagctatccttccacctctgcctccctaacagctgggattacaggtgtaagccaccacgcccagcccatcttttattcttttaaatattttctattgtttgactttttaataatattttcatgttttccctttataataatagaaagtgtatataatgaactctgctaggtttgtcaatatttacacagaatctcttggtgacctgctctaatgaaacaataatagtttgtaaatatattaactcattcaacaagtattaattgagtgcccattgtatgccagggactgtaccaggccctagggatacaataatgagaaaagatatatatgcaagagaaaaaaataattacacaaacataaaattttagttctagcccctgtaatggagaaagagatacaagatgctctaagaacctgtattgggagatttgatttcatcagggagttcagggaagtgcttcttggtaaaatgaggtctgaatatgaatatgagttaactaagtaaagaaaggagggaacaaccatgcaatttgtgatttattctcctcagtgagtggaaacagggcaaggggaactggagatgaggctagagaagtaggtaggagtcagatcttaaatgccagctacaagctttgctttgtcccaatactgttggaaaccattgaaagcttttttttttcattttttatcatttgtattttgatgttgtttttggggtggtacatgtcacatcacatttgcattttaaaaagattgctctggttgtagtgtggagaatggagtaggagtaggggtggagtcccagttaactgtagattgactgttaaaagaatattgcaatatctgagacatggttagatgggaccagggtggactagagagcagtgaatgtattggaaagatatttaggagatagagtcagcagggcttggtgatggattggatatggggaaagtatgtaaaagatgacttctggtgttctggcctccatagctgagttgatgatgttgcaggacccgtgttgcaggcagagcagagaggatgaaaatcatgagttcagtctttgaaatgctccagaagagatgtcaaggtggccaggcacggtggctcacgcctgtaatcccagcactttgggaggccgaggtgggtggatcacctgaggtcaggagttgagaccagcctggccaacatgctgaaacgctgtctctactaaaaatacaaaaattagctggacatggtggcagatgcctgtaatcccagctactcgggaggctgaggcagagaattgctttaacccgggaggcggaggttgcagtgcgccaagatcgcaccactgcactccagcctgggtgacagagcgaaactctgtcaaaaaaataaaataaaaagatgtcaagaatgtggttggatattacaagtctggcctagacaagtgttctgacatggagatacaaatttgagccatcagatgcagaaaagtgatcactgaaaccctggatataaatgttatcacctagaaaaaagaagagtgaggagaggtcttgaatctagaataattctagcacttaagagctcggtagaagaggatgaaccagcaaaagagactgtgaaagaacagctagagaaataggaagaaaacagaagaatgttatgttggaaaaccaggatgtcatgccaaacgctgccaagacattaagtaagatgaggatcatctgattttgtgacagtagagattagggattttagcaagtgagagctgtttcagagaatagacaggacgagatgctgatggtgctaatggagactgcaaggagatactcagaaatgtgcccatgacacggaagagggactacagagggtgagggtgacagaggaccttttttttttaatgggagaaacttgagcacatttgcaagggatgcctgatgggataaagtccctgaaaaggcctgagtggctgagccctgagcagcagtggagggctggctccagcttgatagtacctgcaggcaagtgctaaagttttagagcatttattctctatgtatttcaaaatattccctttaccttgtttagtaaatgtcatagcagatcaaaggcaaattaacctaaagttctgtcagaattatcatgaatatagaatttgtgaagatcaaattcctatagttttactatttctagaaaagtaatagttttttgttgttgttgtttttgagacgaagtttcactcttgttgcccaggctggagtgcaatggtgcaatctcagctcactgcaacctccgcctcctgggttcaagcggttcaccagcctcagccttccaagtagctggaattacaggcacccgccacccacgcccagctaattttgtatttttagtagagacggggtttctccatgttggccaggctggtctcgaactcctgatctcaggtgatccgcccgccttggcctcccaaagtgctgggattacaggcatgagccaacccgcctggccaattttttttttaagttttcattatctggaattctttgttgtttttgagatcagaatctctactaatgatactcaagatgggtgtaactacaaaatctgcagatgttgaaagaagcaaaatggatctgttgaaatttctctttttttctttacttttttttttttttttttttttttgagatggagtcttgctctgtcgcccaggtgggattgcagtggtgcaatctcggctcactgcagtctccccttcccgagttcaaggaattcttctgcctcagcctcccaagtagctgggactacaggcacctgccaccacgcccggctaattcttgtatttttagtagagacagggtttcaccatgttggtcagctgatcttgaattcctgacctcaagtgatctgccctcctcagcctcccaaagtgttgggattacaggcatgagccacaggcccagccagaatctgtgttttaataagatccccagggggtatgtgatatgaacgtttgagaagcccaagtctaaggcaggataaacatggcccgaggggaatctgggcatcacctctttctgtacagccagggagatgggaatggtttttacattttttaatggttgggaaaaaaaaagaagactatttcttgacacattaaaattatatgaaattagtatttcagtgtccataaataaagttttattggaacacagctacgatattcacatattgtctatggctgctttggctcaaaaagaattgttgagtaggcatgacagaaatcgtgtggcccaaaaagcctaaaatatttatgatctggcccttcagaaaacgttctccggcttgtgatctaaagtgcactggaagtacattctttgtgggtttccaagtagcttgtacaccaaggttagctgattataacaatgtgttgtttaacgatcctttatcatattaaagttgaattaataaggcaaaatcagtatttaaacataagaattatatattcaagcttcaaacttgaggaaatgccactttgacttttttttttttttttaagatggagtctcactctgtcaccaggctggagtgcagtggtgcaatctcggctcactgcaacctacacctcctgggttcaagcgattctcctgcctcagcctcccaagtagctggaactacaggcgcgtgccaccacacccagctaatttttgtatttttagtagagacagggtttcaccatgttggccaggatgatctcgatttcttgacctcatgatccgcccgcctcagcctcccagtgtgctgggattacaggtgtgagacactgcacccagccctgactatgttttctaaatgagatgctggtgaactaaagagtttcttagtttaccttttgtttcctaaaaaatgaaattatggggaaaataataaaacttataggataaaaattagtaatactggtaatctctggagagagaaactagaaggggtgggggcaagagtataaaggagactttattaaattcccttttgtgcctttcagaattggatctgggattcaaacatatgggataagtttgctatcattttccccataatttcatgttttaggaaataaaagatacaattgttactcctcagaatgttttgtcttatgctgttgttagatagtttgaattaagtcttctctgtcctcaacacacatgatggttgtcgtcttgctctgagaatcaaagttcacaatccttgctcatctaggtgggaacctgctcgtgctggtggatcagcacgctgcccatgagcgtatacgtctggagcagcttatcattggtaaggatctgtttgcagccagaaaaaatttgagactcccagcagaatcagtacacctcaaagagcttttctaactgcaactgttgtgagaaagcacactttgtactgtatgttcaaaaattaaactaaagtcctgcagtttggcctgtgttataattgaaagaatgtggtagttcactaattgaaagatgtgaacttatttatgtggtcagaggcatatttgccagatgttattaacaacccagaagtacgcaaggataggctgcttactctgacatccagcacaaagctctgcccctccatatgcccggtgatcttggcatgccttcccacactccatcaggcagagaccagtggcagctcagaaggcccagtatgctgttttgattttaaaatttagtttgcttttgaatatgcagtataatcaaatagatccaattctgaaaggcacaaaagggaatataataaagtctcctttctatccttgtccccacccctcctagtttctctccccagagacaaccaatatctctggtttttaaatctatctttccaaagcaatatatgctttttaaatgtttttttttgctacccttttcctcatcatgaggcagtgtgttcaccaagtggtaaaataccaggaaagtctttactcctgtggccaatgagtaatgtcaaagagttaggcaaggacctaaggagtgcttcatggactagaatggcaatgatattactactgttttcacttttccttataaaatgacggcctaagagttgggaaagatatagtaaaaacagtgttagaaaaacttacctctacaggccctgcaccatttgagaatagtactaattctctccagagactgggagaccctgctcaaggaaagggaagccttctggagccataagactgtgtggtcaacccacatatgttcctggtaatccacattattcacctctgtcatcaaaacaacatttattaactacaggaacattggcttgttcatctgaatgtaagatgcaagtcttatatttcttattttgaaaaatactaccaaaattgttaataggctgaatatttattagtttgactttaaaaatggaaatccaaaatctaaaactgaacattaaacattctgctttgcattagaatgattatctcaaggccgtgctttatttttatctgaatctagaagacttcccttcctactcttaacccattcatctttctgccaatagattcctacgagaagcaacaggcacaaggctctggtcggaaaaaattactgtcttctactctaattcctccgctagagataacagtgacagaggaacaaaggagactcttatggtcagtaccaccatgagaatgtgatgttgatggtatcaattctcacaataattctgtgaggaataagcataactattgttccatttctcagatgagaccaagagaggttacaagacttgtctaaggtcatagcagttattaagtagtggagcaggcactcaaaggcaggtcgtctgactccacaggctgtttgtttccttttttaaaatatatttttttctgcatccaatcatccattaaaatatttattttgtgagacatggtctcactctgttgtccaggctggagtgcagtggcacaatctctgctcactgcaacctccaccttccaggctcaagcagtcctcccacttcagcctcccaagtacctggaactacaggtgagcaccaccatgctggactaatttttgtaattttttggtagagatgggttttcgccatgttacccaggctggtctgaactcctaggctcaagcgatcctcccactttggcctcccaaagtgctgggattacaggcgtgagccactggacccagcctattctttccactgtatcccagctgaagagtataggatagagtttccctgataattttttccagcagttggcttagaacactcttctcatttcttggaacagtctgtgtttatgccatgctttgtgaaagcaaagtttctgcagtaattggtcccattctgctttgctttggtgcattctagactcttagttttcattatcgtaatcataatgggaagaaagtaaaacattgggatgtaaggaaggggcgaatcatatagtgagtcacaagataggatatttttcctcttctaggcagcacaaattattgaaaatgaaaaagaaatttctcccaatatgtttcaggtttgggaatatgatactgccagtaaatctttttttccctatgacataatttatattagaggcagatctatttacttacatcccgttagtcaggacttctcaattccttgggctgttaattacctccctgctttaatgctgattcaaatcactctcagaccttttcttcatgccagactcccttaagtgccagcagccagaagttagcagttcctcaatgaagaaaacacacttagaaacaagacttagacacagattgattcccaatggaaaagagaaaaacaataaaggttactgtaattcaaaaaggaaatttgataataaaaaatcccaaacacccacacataagtgtgagaaaaacaatacggttgttaagccctgtggcagcttttgaaaaactattaagtagtatttggaaccagtagtgaagtgcaaatgaagtagcactctttttttttttaacatttgaggttatctctttaggtgttaccacaaaaatctggaagatctgggccttgaatttgtatttccagacactagtgattctctggtccttgtgggaaaagtaccactatgttttgtggaaagagaagccaatgaacttcggagaggaagatctactgtgaccaagagtattgtggaggtaagacacagctgcagatgttaaggaaattgctgagtgatggtaacctcatattttgtctgtagattctctgaattcatcttttcttcaacaagtattcatggtatttacctgcggtgtgccaggagctagaaattcagagatgagttagctcaaaataaggaagaagggcatttaaagaattatagtcagtgaactttggctagtagaggtatgtgttttgctttcttcccagtgataaaggtaatgaaaactaagagtctagaatgcaccaagatagtttttcagaagtgttatggaaacacagaatgacttgtgtgcctggggaggtgaagtcaatgaaaatgtcacagaaaagctgttttcttaagaaaagtttttacttttgagagaccaggtctcactctgttgcccaagctggagtgcagtggtgcaatcatagctcactgtagccttgatctcctgggcacaagcaatcttcctgcctcagcctcccaagtaactcggactacagacacgcaccaccatgcctggctaattttttccttttttttttttgtagagatgggggcctcactatgttgcccaggctggtcctgaacttctggcctcaagcaatccccttgcattggcttcccaaacccccggcactacaggcatgagccactgcacacagccagaaaagtcttacagaatagtgggaaactaggctgggcaaggtggctcacacctgtaatgccagcactttgggaggccgtggtgggtggttcacctgaggtcgggagttcgagaccagcctgacaagcatggaaaaaccccatctctactaaaaatagaaaattagccgggcgtggtggtgcatgcctataatcccagctactcaggaggctgaggcaggagaatggcttgaacctgggaggcggaggttgcattgagccaagattgcaccattgtactccagcctgggcaacaagagtgaaactctgtctcaaaaaaaaaaagaaaaaaagaatagtgggaaagtgctgagtacagaagaggggagaagggcattctagacagaggaatacatatcagagacttgagatacatcctatgtttagggaactatcaatagatatggctcaaattaagatctacagttgatccttggataacttgggtctgaactgcgcaggtacacttaaatgcagattttctttcacctctgccattcctgagacagcaagaccaacctttcctcttcttcctcctccttagcctattcaatgtgaaaatgatgagggtgaagacctttatgatgattcatttccacttaatgaataataaatatattttctgtttcttatgattttcttaacattttctttttctttctttctttctttctttcttttttttttttttttgcgatgcccaggctggagtgcaatggcacaatctcagctcactgcaacctccacctcccgggttaaagcgattctcctacctcagcctcccaagtagctgggattacaggcgcacaccaccatgccccggctaatttttgtatttttagtagagatggggtctcaccatgttggccaagctggtattgaactcctgacctcaaatgatccacctgccttggcctcccaaagtgctgggattacaggcatgagccactacgcctggccaacattttcttttctctagcttacttaattgtaagaatacagtgtgtaatatatacaacacacaaaatatgtgttaatcaactgtttatattattggtaatgcttctgatcaacgttaggctattggtagttaagatttggggaaatcaggccaggtgcagtggctcacgcctgtaatcccagcattttgggaggccaaggcgggcggatcatttgaggtctggagttcaagaccagcctggccaacatgatgagaccccgtctctactaaaaattaaaaaattagccaggcatgatggtatgtgcctgtaatcccagctacttgggaggctgaggcatgagaattgcttgaacccggaaggtggaggttgcagtgatccaagatcactgcactgcactccagcctgagtgacacagtaagactccgtctcaaaaaaaaaaaaaaaaaaattggggggaaatcagaagttatacttggatctttgactggatgggagttggctagatgggttgtcaaggtcaaatcataaaataatttagcatattctactaagtagtttgcattttatcctataggcagccagtgaaaacttttaagcaggagagtaaggtccattttagattgcattccaaatatgattactttacatatatgttttggtaaaggtttggaaagctactgctgggctgtggcattggaggtattagagagaactattactttttattttgattacttatatgtttctttttttatagcaaatatcatttattttgtctttattgtctttttcctctcctttcctgttttctattatagttttctgtatttctctttttttttttgctctactcgtttagaagttatatattccatttatatccttttagagattagccttaacttttagcatgcatacttatcaaagtttaaaagtaattcacttctctatcctcttcctaactgtaccaaaatcttacaaactgttcatctcccatcaccctcctcccatcttccatgttgctgtctagtactttaattccaccttgtttttaattccctggtggtcatttattttatagtcaatctttatttagattaaaaaaagtgttcaccagagtctttgttcaccattgcctcttgcatcctacttattctgtgttcttttgggttttttttttttttttttttttttttttttactgaagtaaatctcttacaagatcttttatccacaaacagatcttgagacaaaaaatacaaaaatataaaaataaatagaagttattttagtaagagtccgtgggccaggcatggtggctcatgcctgtaatcccagcactttgggaggccaaggcgggcagatcacctgaggtcaggagttttgagaccagcctggccaacgtggtgaaaccctgtctctaccaaaaatacaaaaattagctgggcatggtggcaggtacttgtaattccagctactcgggaggctgaggcaggagaatcacttgaacccgggaggcggaagttgcaatgagctgagatcacgccattgcaccccagcctgggtgacaagagtgaaactctgtctcaaaaaaaaaaaagtccgtgaatgataagctgtcttttaaagtatctttattttgtcttcatacttgcatgattatctagctaaaaacagaatttcacattgccagttatcccccccgcattttgaaaatatttcactacttttgactttctattttattttattttatttcattttttgagacagagtctcactctgttacccaggctggagtgcaatgggatgatctcagctcactgcaacctccgcctcccaggttcaagcgattctcctgcctaagcctacaaagtagctgggattacaggtgcccaccaccacacccagctaatttttgtatctttagcagagatggggtttcaccatgttggccaggctggtctcaaactcctgacctcaggtgatctgcctgccgtggcctcccaaagtgctgggattacaggtgtgagccactgcacccagcctgactttctgttttagccattgaagtccttagtcaatccaattattactctgtaggtaatctgattttccctctggttgcttttacgatggttcactttgtctttggtgttctgcaatttccctatgatgtatctttgtatggatttattttcatttccttctggagattcactatgcttcttcagtttggaaagtatgcagtcattatcacctcaaacgtttctttcccattctctctcttgtctcttggaaattttgtcagatatctactgggccttatctttctactctgcatgcctcttcaactctcttccatatttcccattgctttctctctgtgatacattctgtgaaatctcctcacttatcttccagtgaactaaagtatctcttcatcttctgtttaattatgtgtttagcttatccactgagttttttatttcagtgactaaattttttatttcaatggctatattttttatttccagaagttgtgtttttttccccaaatctcactcttccttttttatggtgtcctgcttttttcatgattgttccttctcctttatcagtagctttcttgatttggagcacaggcaaatccacacccacctcatctagaagtctgaagtgctttagtaatatctaaaatagtaaaatctaaaattagaggatagatgtagtagataaattgggggatggatttatgtgggaagatttgagtcagggagagcagctgacgggttattgcagtggttaaggtaagagaagatgaggattggactgagtcagtagcagagggagtagagaggagtgacatatctgagacagaatttgggaggcagaagcaagaggacttggtgagcaatcaaacgtgaaaggaataaaggagaaaacaaaagcaacagtgattctgagggttgtagcatggatggctggaaggatggtggtgccattgacagagaagggacacagatgaggaggaacaaacctgcctaggagttccatcgtgaaggtgggtttagacacagtgaatgtgcctgcaggtggaatgcccagtggataggcacacttaaaagatctggtacttggaaaataaatctgggctgtacatatctatctgagagttaacagtatatatatattgatagtatcagaagctggagaagggccttgaggaagtgaggttgtccagggagaatatggagagtgaaaaggaagagacaaaagagtggagcctgtggaacatcagcatccagggtgcgtatgctttggaaaaggtctggaaagctctgctgaaaagaggaaattctaaggatggctgaaaatacttggttagagagggaggaggaaaaccaggaaaaagcaatattgccaaaactaaggaaagttttaagcaaggagggaatggtcaataacggctatgaagtagagcctgaaacgctggacttgactgtcatgaggacattagttgtcttgtggaatcatttcctggggatgaggtggggcagaagataagagtgcagtgagtcaggagtgcgtgaagcaggaggaagtgaagctaagtagacaactctttcaggaactttggctacacacagaagaagagagatggggtgagagctaaaggttagaagtggttgggaagtgtggggtgggattcaaggctgaggaaaggtgtttgtttgctttaagacaaaaaagacgtaagcaggtttgcaggccaagggggaaacattcaagaggaagagcagctgtcagtcagctcttgggtcatcttggctttgccctttccagaatcgcctttggatcagacagatccaaagatttgctctgcttccagcaaagctctttcctccccacagacatgctttctctaagacccctgctccaaattgtcctaaatccaaaagataggatctgttagagtcttttattgtaattcaatccctaatatgtaaccagaaaattataagaaaaacttttcctgaaggaacttaaaagactactgttaaggagtttgcttcaaatggaaacaaacctctggtttcataaaatcttgattatcctatgtcaggctgatcaggagagactttgtgtgattctggaagaagctggaacagttttggtgttttgaggaggtagctatttgaatcctagcagttgaaagatcattaatacatccttctataaagctctatcttctagcctggtgaggaggtggaggctgcagtgagctgagatcgcgccatggcactccagcctgggcaacaacgagactacgtctcaaaaaattaaaaataataaataaatacggccaggtgcagtggctcacaactgtaatcccagcactttgggaggccgaggcaggcggatcatctgaggtcgggagttcgagaccagcctgaccaacatggagaaaccctgtctctactaaagatacaaaattagccaggcgtggtggtgcatgattgtaatcccagctactcaggaggctgaggcaggagaatcgcttgaacccagaaggcagaggttgcggtgagccaagatcgtgccattgcactccagcctgggcaacaagagtgaaactccatctcaaaataagtaactaactaactaaataaataaataaaaaataaaataaaaatattaaattatccagcattaaacagaccattggaatataaaatggactgagatgagacccatcaccccttcactaagcttacaaacagatgttttaccatcccagatgtacaaacacaagaatgtttgctctccatccacactaagctttgtcagtggattgagtcttatgagaccatctttctgtttaggtttgtttgggaaaacatgtgatttttaaattatatgtaatatagtatctactacctagctcttgataactgtgcccatttataggcatggcagactagagtatagatgaaggagggaagagaatttcctgagtctggttttaaaagaaaaggtaccatgttgtaatcttaggagcagatttacacatagccttttccaggagtaaagaaatgattttcttataaagaaatcattaaatgtgcaacaggtttttttctttttacctccagaggttaaacaaattggtagcatgaaatagtgtctgctttaaatttctttaagcttcttttgtaaatattaatatccacagggatataactattgaaaaggttaccccagggacagagacatgcaagggaggagaaatttctcaacaaagggcctcagaaaataaactttctgacctgaagggaattgtccccaaaaagcccgtgggaactaaagtgactgtttacttatgtttatgatatttaagcaagtgttatactgagcagtggttgtgttgatggttgttgtgtatttattctcagtttgtgtgtaatattacgcttgttctggctaagattacacacacaaacagacagccttttagtgagaagccttcctgatgttttgaattggttgaatcatcaaggctactctcaccagctacataacctcattagttgagaagctatctctggaggaagtctcagtagctaaatatattctgtgttcaataagagttctattcagttgcttggttttttcatattcaaagtgccttacaacaaataaatttgtacccaagtgctgtattgctggaactctttctttcaggaggcatgatttaaagaagaaaattgagatattttgtaaactatcaaagggcaagtaaaacataaccgtagattaaagccgattttccttttgctttgcaggaatttatccgagaacaactggaggtaagcttttcctttattttggggtttcacacagaagcaccacacataaaaggcttcgttgttccgttttcttttcctgttaataacgtgtttatgcattagctactccagaccaccggaggcatccaagggacattgccactgactgtccagaaggtgttggcatcccaagcctgccatggtaagcccttcaacatagcagtgatcaaacacctctgcatgcagagccctggcagggctgccgggattacaaaagaggcagagggtacatttactacttgactcttggagaatacaatttagatcaagaaactgaatatacccttttaaaaatcacttttacaaaaacaaaatcccaacacaaaaatttgactatagtgctgcctgacctatatgagtggaggaataactcctagaggagatgcattttgagatgaattttgaatgagctggggaacatgggttcatagcatggaaaggggaattcactatagggagagtaaacagcctgtgcagagaggcagaacagaaacaagttagttatatgagaagcagcaaagagtatcaagaaactaggcaggtaagagaacagaaacctagaaggtcacagcaaaacctttggatttgatacagaaggcattagaattagcaagcgttctttttttatctttccaactttcattttaggttcagggggtacatgtgcactttgtaacatgggtgagttgcatgtcgcaggggtttggtgtacagattattttgtcacccaggtaatgagcatagtacccaataggtagttctgatcctcacccacctcccaccctccaccctcaagtaggcccaggtgtctgttaccccttctttgtttctatgtgtattcaatgtttggctcccacttttaagtaagaacatgcagtatttggttttctaattcacttaggatgatggcctctagctctatgtttttgcaaaggatgtgatctcgttcttttttatggcgacatagtattccatgatgtatatgtaccacattttctttatccaatccaccattgatgagcattgaggttgattccatgtctttgctattgtaaatagtgctgcagtgagcataacacatgcatgtgtctttatggtagaatgatttctgtttctttgggcatattcccagtaataggattactgggttgaatggtagttttgctttaagttctttaagaaatctctaaactgttttccacagtggctgaactaatttatatttcccaccagcagtgtataagtgttctgttttctttgcagcctcaccagcatctgttattttttaactttttaataccagccattctgactggtgtgagatggtatgtcactgtgattttgatttgcatttctctaatgattagtgacattgaacattttttatatgcttgttggccatgtgtatgtcttcttttgagaagtgtgtgttcatgtcctttgcccattttttaatagggttttttggtttttgcttgttaatttatttaagttccttatagattctggatattagttccttatatagattctggatattagacctctgttggatgcagtttgcaaatattttctcccattctgtaagttgtccgtctattctgttgatagtttcttttgctgtggagaagctctttagtttaattaagtctcacttgtcaattttcgttttattgcagttgcttttagagtctttaccaggaaatctttgccaaggcctacgtccagaatggtatttctgaggttttcttctagggtttttgtaaaaagatggaatgcgcccaggcgcggttgcttacgcctgtaatcccagcactttgggagaccaaggcggatggatcacctgaggtcaggagttcgagaccagcctggccaacatggtgaaaccccatctctactaaaaacataaaaattagccaggcgtggtggcgggcacctgtaatcccagctactcaggaggctgaggcaggagaatcacttgaaaccaggaggtagaggttgcagtgagccaatatcacgccactgcactccagcctgggtgacagagtgagactccatctcaaaataataataataataataataataatgaagatggaatgcttcatgaatttgcatgtcatccttgtgcacggaccatgctaatcttctccgtatcactccaattttattatatgtgctgccaaagcgaacaccattgagggttcttgagcagggtaatatgatacaatatagaaaatggggagctgggtgaggccctgtgaggaaggtgcctgcttctccttcaccttccgccataattgtaagttttctgaggcctccccagccatgcagaactgtgagtcatttaaatggtctttcctttataaatgaccgagtcttggtcatttcttcatggcagtgtgagaacagactcatactcctctatcaccaaatgtcatcattgccaccttcaaaatgtatcttcggtccgtctgattcagtctgtctggctcctccctcatttttgccactgttgagctctcttacttagttcttcacatccactctggctccctttcaagctgctcttctctcagcacccagaggaatctttttgaaacatccctccaagcatgttgttcttctaactaaaatgtgtcaatgatgacccattgctcttgggatagaaatgtgattttttactgtggcccacaagggtcttcgtgatttggcccctgcctgcctctccagtgtcacgtcatatcactctccaccttgttctttacatcccagcctgcttttttggtcttctgcttcctgtgtgctaaacatttgtcagcgtcggggcctctgcactggccttctcctctacctgaaacacttttctctccttcttcaattagccacgtctttcttaacctaaagtctcagcttgaatactactttgccaggaaagccttccttaagctcctaaactgggtttggtcttcctattatatattcatatcctgtattttatagcacctatatttatcatttaaattattgtataattatctgcttcatgtttgtctcccctattagaccataagcgccatgaggatggaaattatctgtctcactaactgcctgacaaagctcccaatacaaagtatatacttaataaatatttgttgactgggtaaattgtgcataaaggcaggttataacaatatgagagtttagattaggaagattattatggaaattagaaaaaaagaagcaaataaaatgaacattgtaaggaaacaatcagagattgctattggacgatccatggagaaagataaccccaacttcacaaacccataaagagtaggcaaaaatactgctcttgcctcttggagaaaaactctgaaagccagatcctaacaagttaaggaatgcctcctacagagattagaaatacaaatactccgtaagaaaaagctgagagacagaaggtcagtcctgaagccttagtttcatccatggtcataagcactaatttatttccctctttttttttttttttttttttttttgagaacggagtctcgctttgttgcccaggctggagtgcagtggcgtgatctcggctcactgcaacccccgcctcctgggttcaagtgattcttctgcctcagcctcccaagtagctgggactataggcgcgtgccaccacacccggctaatttttgtatttttagtagaggcgggatttcaccatattggccaggctggtcttgaactcctgacctcatgatctgcccgcctcagcctcccaaagtgctgggattacaggtgtgagacaccatgcccggcctataagcaccaatttcaagcaggattaaagcttcattaaagaagcctaagaaacatgttactttttccagatatttggcagtgacccaaggtcagcattggtttcccactatatacactataaccttcttgtttctgtctttcatttaggggccattaagtttaatgatggcctgagcttacaggaaagttgccgccttattgaagctctgtcctcatgccagctgccattccagtgtgctcacgggagaccttctatgctgccgttagctgacatagaccacttggaacaggaaaaacaggtacattaatgactaacaggagcaggagggagcaaagtttattttctctttcttttctggcttttactatgcaactgtaatctgtcttaacctttccaaaataggagagttttgcaaaatctgcactggaagtttcacataaagcctcacccatttcattttccagctcaaatccaaaatggaacttagactgaactgtcaggtcacctacataatggctttgtattttaaaacttaacacatgtacagacttatgtaccctgaatatctattgcctgctggctctaggtttcataatatgcagttctttctgaagctactgaaagttggtagaagcacagcaaattcactgttggcaatatagagcctcaacttccagtttcttgatagtacctgctggaaacggtgatctgtgactgtagctggccatccccaaggatcttgagttatggtttgaggatcatcagacagggacccaagcttggggatctctacattatgctttggccctaattacccagcaacctgcaaactacaatgtggataatgcagaaaaggcacagaatggcttaaatgaagaacttctgtccttgttataatcttcagtgaaggagaacatggagaacataacaggaatgtccctgttgctgctttccaaaatctttcctttttttttgttttttgagacggagttttgctgttgttgcgcaggctggagtgcaatggtgcgatcttggctcaccgcaacctctgcctcccgggttcaagcaattctcctgcctcagcctcccgagtagctgggattacaggcatgcgccaccacgcccggctaattctgtatttttagtagagacagcgtttctccatgttggtcaggctggtctcgaactcccgacctcaggtgaactgtccaccttggcctcccaaagtgctgggattataggcatgagccactgcgccctgcccaaaatcttttcttttgctaacctttccctgctaagggatataaaatcttttcttgcatggagttttcaggtactaatgttgtctgactcaactagctgattttacttcattaaaacctctttgtttcacaaagaaaaatatgaagaaagtttttctccattgctgagagctgggaatctagacttaaagttctgagtccccttggatccttaaaacaatctgtaatctctattgaatccagaagttagaaatctaaacagattataacagccagactttggaaatatttgtatgctacctacattttcaattttttttttttgagacggagtctcactctgtcgcccaggctggagtgcagtggcatgatcttggctcaccacaacctccgcctcccaggttcaatcaattctcctgcctcagcctcctgagtagctgggattataggcatgcgccaccacacccggctaatttttttttgtatttttagtagagacagggtttcaccatattggccaggctggtctcaaactcctgaccttgtgatccgcctgccttggcctcccagagtgctgggattacaggtgtgagtcacctcgcccagcctgtatgctacctaccttttcatattgctaattgaagttattctttcttcccatagattaaacccaacctcactaaacttcgcaaaatggcccaggcctggcgtctctttggaaaagcagagtgtgatacaaggcagagcctgcagcaatccatgcctccctgtgagccaccatgagaacagaatcactggtctaaaaggaacaaagggatgttcactgtatgcctctgagcagagagcagcagcagcaggtaccagcacggccctgactgaatcagcccagtgtccctgagcagcttagacagcagggctctctgtatcagtctttcttgagcagatgattcccctagttgagtagccagatgaaattcaagcctaaagacaattcattcatttgcatccatgggcacagaaggttgctatatagtatctaccttttgctacttatttaatgataaaatttaatgacagtttgattggttgcttggtttgttatttgaagggtgtgatttttgtttttgtacagttttttttcaagcttcacatttgcgtgtatctaattcagctgatgctcaagtccaaggggtagtctgccttcccaggctgcccccagggtttctgcactggtcccctcttttcccttcagtcttcttcacttccctatgctgctgcttcatgtgctacatctcagacttaaagagtttctctactacagtgaaaacattctctagggtctttcatcaggcctttagttattttagggataaaaactattgataaaaaggacaaggatagaacagagaaaatttaaagtcctgttccgggttttttgttatgttttctttaaaaactcagagactgatgttcaatatcccaaaccagtaaaatggtgaaaatactatgagcttgttttttaaaatatgattttttttggtactttataaagtatctctttatgtgaaagcaattgtcatatcaaaacacagcatacatacgttcaacctaaccaaatatctttacactttttctttcaggagacaagggttctttgggtccctttcaaacggtatcttggtgttattacattatgcctatctattgcccttataatatcacttgggaccaggactgatcgttctgcaaatgcttgttatgccattctcaatctatttttcccgcaccttttcacatgatttgtggttaataggactcaacagactaaaattgcatagtagaaaaaaaatgcaaaaagccagctggtaatgtttattgcaactggggtgctatacaattagtaagatgatgcaatgagaatttctacttttgtatttcctgaccagcctgctcaaagtggcttttatatcaattgaatgattttcctcattttttaatacaggaaaccaattcgtgctcatggaagaaaagttcctttgccagcagccttgaagtgaatcttacaggagcaatgaaagtattgcattcattagcgtctgccccagagaaggttcagagaaaaccttcacttgttttcaaggggatccttgtagatttacgtaattggaatcctgaagaacaggccctactgtctaaaaaatggcttttattcttctaaatacatataaacggatgttttatagatgggaagacatgaccttagaaaggagagagttttcagaggatttgccaggctgtcaggggctctgcctccaggcccagtgtggcagtgtggcctcagggcctccgcctccctgcttgagggctgcatggaggccaactgtcctgggagttgtaaaaatcttttaaggccagaccaatttgagggattttaaaaagtgtctcagtgcctcttatgatttcagaaggttttgctatatgtaatcccaactactgttttcttgagagtagcagaggattagaaaaagtcctccataaattatgtaaccggccttcctgactagcctgactcaagcaatgtaagagataattattctgttttcataatttataagtgtgggggcatgcctcagcataaaaacaacctattagggaaaaatatctaatagattacctttatcgcctgttagggttttatgttgtttttaactcagatgccataagaacaaagatacatgtaatttataatagtaatcattaatacctatattgtgctttaaggtttacaaaataatttttctcatactttatcttagtttagtttcttgacagtccatgaggtaaggtggtagctttatcaccattttacaaagtgggaaacgaaggttcctcttaggaacctagttgtcacctttgtataataaaacttcgaagctcggagctgttaactggtttgctgaaggcttagctgtaagagccagaattcagacccaggtctgagtgacttcaaactgcacagtccttcccattattacccatatgctatcccttatatttttaatttattaggaattcattcatttataaacttggtgattcacctttattagattctggtcgctgaaggctttagtaacttcagagtaaaacttgagagatgagatgtaaaatgcagccattcttgagagttcctttttctgtaacattcatcaacacttcattgagaagtgaaggttcctatggctgtctctaccttcaagaggcttagctttagtcactgagaaagacaaggaaactaatgatagaatatagtagcttcttctggcgttaggtatcacagagtcacagctagttacagctagccctttattattgaaagaagaggagctagcagtcccactatcagaattaagactagagatggtaataggagctagtatcagaaaagcttaaggcaaagcataaagtgtaggctagaatgaagctggagaatggggagggggcttgggtaacatccagaacctggctggggacctggaactacatgagatgtaagaatggagaggttctagcagtcagaggtcaggtacaaatgaacagctgggatctgcgcatggcagacagtgaaaaaacccaggcaagcaaaatggtcagagcagaaaggggcccaaggccacgttcttgagatgtggagggggctgaggaagccacgccaagtaaggacagatgcagctcagcagttcctagcgagccctgacaagccagctcagctgaagcttcgggtgggagccagtcatggcacagtggagtgaaggaagagcagtttcaggcacccaaaacctgacccccacgacctgttttccacctgaagagccacccattccatccaaacccttggcaaaagtctgctaacagagagaaccggccagtatgctggccagtcgcgatcatgcctgtctttaccctctaagctgaagctgctcatcaacggtgagatggcaaaaaggtgggtccagaagaggggaaaagaagggagtctgtgaaaacaaaatgctgaagaatctgcatcaaataaacccttccttccttcctttttccttccatccctctcttcattcagcaaatcttcagtgagttcctttctaaatgtattgtatcagaacttgtgggggatataaagaaaaaaaagaggttatcacatggcttaggatgtttccaacccttggatcattttcaccccaggcccattagttacagagcactcagtcttacccagaagcatcggatatagtccaggcaaccggatccaagcgtgtgggaatcgcagtgtgctgcatgtgggaatctatcaggccaggatgattcaagcagcagcctgcagaagtgggatttggccagccttgcctgactctggccttccaacttgctcttatctacttccaaagtaaggaatgccccatgatgggccgagcagtccaaaaaaagtggcttggagttagctaccgcaattagcagtttctcattattcaacactgcattacctctttttcatattaactgcagaattttatttttatgtatttattatccttccaaacccagtgttgtaggaagaatattacatataaatgataacttaggaatcttgtcaagtttttgtttcttcagcactaagtagcttattttctaggcaggtcttaattctaaatgtaacatgcttgaaaaaaacactattgaaaggatccgtctcttcagcatagtatttaatatacatatcaggcaatcaccatctcaagcatgattagactcaagtgctgccctccatcgtgtgagggatgctgggagactggaagcttagactttagctctttaagttggtgcaaaagcaattgcagtttttactattaataataataattgcctagccattgtgcagtaccttgcaagagctctttggcaaatgaaagaataattcaaagcaaagtaggccagatataaaacacttccaaatcacatttcaaaattgttctttcatgtcaactaggtgcatgtctgctaagggagtttttgcaaggacaggtggatagtgtgaggcctttacaataatcacatcaccatctggtactatctgtatggcagagcagttctgatgtagttgtagtattatagatcattacagagtatgccagtcattccatgatggaactgtgactggcagccttcattagcccaaagactgatgcaacagattgctttgagaaatagttttgaagcacatccatgaaacatatgatcctatgggttccagcattgatttctttgaggtatcattttacacttcagtttttcctggtagagtatttttcagagatgtctcttctgaggctaaattaggaatttctgttccttattcaagttccaagaattgtgcctttcctgccctctgcccaaactggaagatagaaaccgtgggaaaaaagtgtctttacaaactgcactgttatctaacttggtttatttagcatattgaggaagactttcacatccatggaatcctagttctattaattctctccaagctacaacagttgtttttttgtttgtttttttccgagtttctcggttccgccagcaaggcaggggtgggaggtgggcacccctgataccaaggctgacaggtagtgagttgatgtggaacttctgtttcctcctgttcagttcaggttctctctttctgatacttacccctcctcaaatagggaaacggagagaggggaaataagaagatgagccttaatagggtttacttaattggggtcataaagattctaaaaagtatgcattcctgcagttctgttctaggcactgtaagagctgaccagaaagagagcttctacccttataaccttcatccaactcagtcatgcctgggaaggatgttggtgctaattttagacacagagactaagatggacaaaggacaagtatcataaagcatttttggagccaggaacagatttaagttccttgcctcactgctgctcttactccaaaccacacaattgtacccaagtgaattgctgttagaattggtgcctttg

SEQ ID NO: 2 - DNA, 122 bp, Homo sapiens
aagttcacaatccttgctcatctaggtgggaacctgctcgtgctggtggatcagcacgctgcccatgagcgtatacgtctggagcagcttatcattggtaaggatctgtttgcagccagaaa

SEQ ID NO: 3 - DNA, 25 bp, Artificial Sequence
  Description of Artificial Sequence: Synthetic oligonucleotide
tcccacctagatgagcaaggattgt

SEQ ID NO: 4 - DNA, 25 bp, Artificial Sequence
  Description of Artificial Sequence: Synthetic oligonucleotide
tctggctgcaaacagatccttacca

SEQ ID NO: 5 - DNA, 20 bp, Artificial Sequence
  Description of Artificial Sequence: Synthetic primer
tcctttccttccgagagctc

SEQ ID NO: 6 - DNA, 20 bp, Artificial Sequence
  Description of Artificial Sequence: Synthetic primer
ttttccgaccagagccttgt

SEQ ID NO: 7 - DNA, 25 bp, Artificial Sequence
  Description of Artificial Sequence: Synthetic oligonucleotide
tctctgactggaaataattgcctat

SEQ ID NO: 8 - DNA, 25 bp, Artificial Sequence
  Description of Artificial Sequence: Synthetic oligonucleotide
attctcaagtacaacatccacagcc

SEQ ID NO: 9 - DNA, 25 bp, Artificial Sequence
  Description of Artificial Sequence: Synthetic oligonucleotide
tgacacctgtactgagaccctaaat

SEQ ID NO: 10 - DNA, 25 bp, Artificial Sequence
  Description of Artificial Sequence: Synthetic oligonucleotide
tctctgccacccttacctctgttat

SEQ ID NO: 11 - DNA, 25 bp, Artificial Sequence
  Description of Artificial Sequence: Synthetic oligonucleotide
catccacagtatctagggcaaaagg

SEQ ID NO: 12 - DNA, 25 bp, Artificial Sequence
  Description of Artificial Sequence: Synthetic oligonucleotide
ccacctctggataacgggcaaatac

SEQ ID NO: 13 - DNA, 25 bp, Artificial Sequence
  Description of Artificial Sequence: Synthetic oligonucleotide
cagcaacctagaaagactcagcaaa

SEQ ID NO: 14 - DNA, 25 bp, Artificial Sequence
  Description of Artificial Sequence: Synthetic oligonucleotide
gttaatcttttacctgcattgaatg

SEQ ID NO: 15 - DNA, 25 bp, Artificial Sequence
  Description of Artificial Sequence: Synthetic oligonucleotide
tgctggagaacctgtcagacattca

SEQ ID NO: 16 - DNA, 25 bp, Artificial Sequence
  Description of Artificial Sequence: Synthetic oligonucleotide
actccattcttacctgcctcgccat

SEQ ID NO: 17 - DNA, 25 bp, Artificial Sequence
  Description of Artificial Sequence: Synthetic oligonucleotide
gttcccacctagatgagcaaggatt

SEQ ID NO: 18 - DNA, 25 bp, Artificial Sequence
  Description of Artificial Sequence: Synthetic oligonucleotide
tgcaaacagatccttaccaatgata

SEQ ID NO: 19 - DNA, 25 bp, Artificial Sequence
  Description of Artificial Sequence: Synthetic oligonucleotide
gaatctattggcagaaagatgaatg

SEQ ID NO: 20 - DNA, 25 bp, Artificial Sequence
  Description of Artificial Sequence: Synthetic oligonucleotide
acattctcatggtggtactgaccat

SEQ ID NO: 21 - DNA, 25 bp, Artificial Sequence
  Description of Artificial Sequence: Synthetic oligonucleotide
gtaacacctaaagagataacctcaa

SEQ ID NO: 22 - DNA, 25 bp, Artificial Sequence
  Description of Artificial Sequence: Synthetic oligonucleotide
taacatctgcagctgtgtcttacct

SEQ ID NO: 23 - DNA, 25 bp, Artificial Sequence
  Description of Artificial Sequence: Synthetic oligonucleotide
cctgcaaagcaaaaggaaaatcggc

SEQ ID NO: 24 - DNA, 25 bp, Artificial Sequence
  Description of Artificial Sequence: Synthetic oligonucleotide
tacctccagttgttctcggataaat

SEQ ID NO: 25 - DNA, 25 bp, Artificial Sequence
  Description of Artificial Sequence: Synthetic oligonucleotide
cggtggtctggagtagctaatgcat

SEQ ID NO: 26 - DNA, 25 bp, Artificial Sequence
  Description of Artificial Sequence: Synthetic oligonucleotide
ctatgttgaagggcttaccatggca

SEQ ID NO: 27 - DNA, 25 bp, Artificial Sequence
  Description of Artificial Sequence: Synthetic oligonucleotide
aatggcccctaaatgaaagacagaa

SEQ ID NO: 28 - DNA, 25 bp, Artificial Sequence
  Description of Artificial Sequence: Synthetic oligonucleotide
tgctcctgttagtcattaatgtacc

SEQ ID NO: 29 - DNA, 20 bp, Artificial Sequence
  Description of Artificial Sequence: Synthetic primer
gcatttcgatgtagccctgg

SEQ ID NO: 30 - DNA, 20 bp, Artificial Sequence
  Description of Artificial Sequence: Synthetic primer
ttgcccgttatccagaggtt

SEQ ID NO: 31 - DNA, 20 bp, Artificial Sequence
  Description of Artificial Sequence: Synthetic primer
caaggcccagatcttccaga

SEQ ID NO: 32 - DNA, 20 bp, Artificial Sequence
  Description of Artificial Sequence: Synthetic primer
agctccagttgttctcggat

SEQ ID NO: 33 - DNA, 28807 bp, Homo sapiens
cactatgttgctagctggtcttgaactcctggcctcaagtcatccttctgtcttggcctcccaaagtgttgggattgtaagtgtgagccactgtccctggccagttggtgatttatttgtataactgtccaatttattgaatacgtatggcgtgccaagcactgggctgagggcttcataatgccctttcactcaatgcttagcacaacccatgaagaaggtagtgttaatatcatccctgttttacagatgtagaaactgaggcacaggctaaataacttgcccaacaagctcgtgcagtttagtaagcagctcagctgggatgtgaacacaaactttgaatacagagctcttaaccagtaggccagaggttcccaaacacctagtatatttactaccttagtactttcctgccacatctcctaggccaaaacaactccattgattgttatgcaatttactaagtgtagccatttgaaaaaaaaatacatataaaagaaaaatatttttattcagttttcaaaataacccatatatagtcatggaatgtatgtgttggttgggcactgcagactaaagacagtttagggccgggcacggtggctcaggcctgtaatcctagcactttgggaggccaagtagagagaagggcttgagcccaagagttggagaccggcctgggcaacatagcaagacccagtctctacagaaaataaaattatcagggtgtgaggacgcacacctgcagtcttagctgcttgggaggctgaggctggaggatcagcctgggcaacagagtgagaccctgtctcagaaaaaaaaaaaaaaaaagacagacttttattcagatatgcatgcaggagttcacagaaaaaaaaagtgagtccaggaggctgttatttggcatttatacaactttttttttcttgaatctcgaaatctactttatatataccatttaataggggaagaggagggagaaaaagccttccatgggaagaacaaataggtttctgggggaacaaaagggagataagaatgtttgtttttgcaggtgcaagtggtctttgtctttttttctggccactaaaactcccctagagaggagatttacggcagcttcactcccagaaatttctgctgttagtcgcataagggaagctttgaaacggcatctttctgcatctgttggctctcaaatgtcttcagttccaagtaacattcatgccaattctgggggtctgagtgtccccacataatacatgtgttctcttgtcttttaatgaagtttgtgggaggcatctaactgtagcctccaaaatttggcccataggtactactgtccttatcaaagacgaggaaacaagttcagaaaagtattaattgctccgagttatctgcttggctagctaggatcagagctcagttctccatttaacccaaagcccaggctcttaacctcttacaactggcgcatcccctctgaacctccatttcctccctgtaaaagaataacatcggccgggcgcagtggctcacatctataatcccagcactttgggaggcagagatgggcggatcacgaggtcaggagtttgagaccagcctggccaacatggtgaaaccccatctctactaaaaatacaaaacttagctgggtgtgttggtgcctgtaaccccagctactcaggagactgaggcaggagaattgccttaacctgggaggcggaggttgtggtgagccaagatcgtgccattgcactccagcctcggtgacagagcaagactccatccccaaaaaaacaaacaacaacaacaaaaagagaataacgttatattcagttgaaccaaaatgaattaaatattaatatttgtacttcaaaaacggtccagcttggctgggcgcagtggctcccgcctgtaatcccaacattttgggaggccgaggcaggaggatcatttgaggtcaggagtttgagaccagcctggccaacatggtgaaatcctgtctctactaaaaatacaaaaattagctgggcagtagtagcgcgtgccggtaatcccagctattcaggaggctgaggaaggagaattgcttgagcttgggaggtgaaagttgtggtgagctgagactgcactactgcacaccagtctgggagacagagtaagaccctgtctcaaaacaaaacaaccaaaaaaccaaaaaggtccagcttgggcaacatagtgaaacttcgtctctacagaaaatttttaaaatactagcagggcaccgggcacagtggctcatacctgtaatcccagcactttgggaggctgaggcaggcgggtcacttgtggtcaggagtttgggatcaggcaggccaacatggtgaaaccgtgtctctactaaaaaacaaaaattagctgggcatggtggtaggcaccagtaatcctagcactcaggaggctgaggcatgagaattgcctgaacccgcaaagcaggggttgcagtgaaccaagatggcgtcactgtactccagcctgggtgacagaataagactcctcaattaaaaaaaaaaaaaattagctgggcatggtgttgcgggcctgtggtcccaggtactcaggaggctgaggtgagaggattacttaagcctgggaggttgaggctacagtaagccaagatcacgccactatactccagcctctgtgacagagccagaccctgtctcaaaaaaattttaaaaagggcaaattttggcaatttcacatagttcaacctagtataaggtggttgtaataactaaatgagataaaatggtgttaaattggaagtattatagtatttctgttaacaacatagggctccagaaccagcttccttgagtttaaatccaggctccaccacttcctagctatgcagtcatgggcaagttacttgacccaactgtgcctcagcttcatccatgatatggagatacaggataaccagcctcttacgtgcaattctgaaatccaaaaagctctgtaaaccaaaagtttgggggtaaactcatttggtagcaaattttgacctgaggctatttatagtctatattctgtattctttctacttagtatgaataagcatgtaagttttactgcatgtttgatttcagcatgttcccccagactctctgggggtgtttacgtatgccggtgggggaaagagaccaactctcaaatattatctcaaacagttggtttcactgtgcttgcttgggtagcacatataccaaaattggaatgacccctgcacagggatgaaatgcaaattcgtgaagcatactgtatttttcttagcacataccacctttggcaatattctttttttttttttgagagggagtcttgctctgtcgcccaggctggagtgcagaggcgcgatctcggctcactgcaagctccgcctcccgggttcacaccattctcctacctcagcctccccagtagctgggactacaggcgtgtgctaccacgccaggctaattttttgtatttttagtagaggcggggtttcactgtgttagccaggatggtctcgatctcctgacctcgtgatccgcccacctccgccccccccccgaagtgccgagtgctgggactacaggcgtgagccactgcgcccggcccccgccttttttttttagattgattttattacttgcctagcaaaggagaaccttctggcagaacagtctccaagaacaaggcaaacaactaattttacataggtttttaccaatgtacagctgttgattgtgactggtttccggcaatctggatttcacaatctggataaggggacaaacaattgtctgtcttccactatctttcttgaatttgaatagaacctttttattctcatagcctcttagctttctttcttttttttttgagacggagtttcgctcttgtcgcccaggctggagtgcagtggcgcgaccttggctcactgcaaacgctgcctcccaggttcaagttattctcctgcctcagcctcccaagtagctgggattacaggcgcatgccaccacgcccggctaatttttggatttttagtagagacgggggtttcaccatgttgactaggctggtcttcaacgcctgacctcaggtgatccgcccgcctcggcatcccaaagtgctgggattacaggcgtgagccactgcgcccggcctctcatagtctcttagctttctaaaatttgaaaaatcctgtaaagacacacctgggtcaaagggctcagataacggactgtggcccttaagtacttacgtcacaggttattgagaggatcgatttagttaccagatgtaaaatgctgggatcagtgcctggcaaaggaaaactttgtacagctgcaggctttcaccatacacaacagcatcgctaacgaatgctattacaatattcatttagcgtttaccaagtgcctactctatacaaatcttgagaatacaacgtgaaggtgaactgctgactaaagtttggtccctttcgctccgtctccttgcgaaaatgctctaacggcaggaggtcacgcgagcgctggacgcgtttctccccgcgagcccctttccgaggcctttcgggtccccccggttatccccgcccgggcggtgcgcgcccccgctgttcccgcttccgctccagagaggcagggctttccgagcctgctagccccgcggccgcaactaaccccgggtcggagtgttccggcccggccagccccgcggcgtgagggaaggggagctcagcagttccccgcgcggggcccaggcgtcggcggcagggcgggcccctcaccgccagcgtgccagccccgcccctacccaccagtgtgccagccccgcccttccccacgtcgccgcgcgcccgggggcggggcctggcgcgcaccgcccgcgcacggcgaggcgcctgttgattggccactggggcccgggttcctccggcggagcgcgcctccccccagatttcccgccagcaggagccgcgcggtagatgcggtgcttttaggagctccgtccgacagaacggttgggccttgccggctgtcggtatgtcgcgacagagcaccctgtacagcttcttccccaagtctccggcgctgagtgatgccaacaaggcctcggccagggcctcacgcgaaggcggccgtgccgccgctgcccccggggcctctccttccccaggcggggatgcggcctggagcgaggctgggcctgggcccaggcccttggcgcgctccgcgtcaccgcccaaggcgaagaacctcaacggagggctgcggagatcggtagcgcctgctgcccccaccaggtagcggggtgggggtggggtcgaaggcgggggcatagcggcggggcgcttggaacccggcgaggggaggctcgcacagggggttgggggggtgcacggcctggccctgggctcggaggaggcggggccgcagagttggcttgaatgagtgcaggggtcgagtctggagcatttgggggtgtagcttgtaaacagggtcggaggagagaggctgtgcaggaagagggctgcaggggagacgcggagagttcgggccttttggagggaggagacgcgtcccgccaggtgggggtgctgggctaaggaaggggcgacgcgcgcagctccgggtggggagggggcctgggaggtgggagcactgggggtggggcgagaaggggaaggcgcccggcccacttggtgggcggggcggggggcggggtggcgggaaggaggaatgcctgcgggaggccgaacggggagagtccggtggtgtggggtgcgaaaggaggttcctcggccggcgcggagatagtgagttggggctccagtagtcgatcgaggtagacacttagaggtagttaagagccgcggtcgccgagacgccttggggacggtgggccttcggcctaggtgaggggccgccgagggggtgggccacgagctgcgagcgcgggggggtgtgtcaccatggggaccgcggggcctaattgggcggggcggggccgtggggagccgaagtgctgggatccggctgggtccttcggtaggtaggctgcacgtgcaccgagacgaagatagaatattttgacgtatgtggaaattcgtgtcgagtggaaaatattttattttatgaaatagtgtaatttttatggggcaccactgggcttttagaggccttaatcgggcgctggacaaagatgtgtggacgtgagtgactccggggaagcctgtcgggagttgtcctcactttatgggcagttaagtgcttttttttttttttcctttttgagagagagtttcgctcaagtccaggctggagtgcaatggcgcgatctcagctcaccgcaatctccgcgtcccggcttcaagcgattccccagcttcagcctcccgagtagtcgggattacaggaatgcgcccccacaccccgccaattttgtatttttagtagagacggggtttctccatgttggtcaggctagtctcggaattcccgacctcaggtgatccacccgcctcggcctcaaagtgctgggattacaggcgctagccaccgcgcccggtctgtttagggctttttatccgggcagctggcgacattttgaaaagcttgcttttgctgtttgccagatacatatatatgtattttgagacagagtcttgctcttttgtccaggctagagtgcagtggcgcgttcttggctcaccacaacctctgtctctggatcaagagattatcctgcctcagcctcccaagtagctgggactacaggtgcgccccaccacgcctggctaatttttgtatttttagtagagacgggtttcactatgttggccaggctggtatcgaactcctgacctcttgatcggcccgcattggcctaccaaagtgctgggattacaggcatgaaccaccgagcccggccgtttgtcagatactaaacacaaagtttaatggtcgctatttgaacaaacgaagaaataaaggctcagaaaaaataactcattcaagataagagccagttcgtgttttttgtttggttttgttttgaaatggagtctcgctctgtcgcccaggctggagtgctgtggcgctttctcggctcactgcaacctctgcccgccgggttcaagtgattctcctgcctcagcttcccgagtagctgggattacgggtgtgcccaccgcggtccggctgatttttcaccatggagtttcaccatgttggccaggctggtcttgaaactgctgacctcaagtggtccacccacttcagcctcccaaagtgctgggattacaggtgtgagccaccgtgcccggccgctagttagtggttttgagtaatggatttcaaatccatttaaatccagtttaaagtgtcctaaaggaattctgagatttttctaagtgtaattatagtgttacccttgtttaagcgaccctttcccgcagtttaaatatatatagttgtgcattagtagaatatgcttgtggggaacagagccagcatccgcaataacaaactcctggttagaaaagcatgacgtattgtttacttgagcatgaattgattgttgaatccaaaccaaacgggtgtatttattgtaaggatgtactttacattcatattgaatagcgtatgttatttgtttcttgaggttgagtttaagagacttgtaaaaataaaacgtatacatttcacctcccgttatggagaggattccagggtattcaagaaagatgggcatttgatactaggtttctaaagaaactgcagtgtctagatcactctgccgagcacagcattaggcattatggatcctggatacaaccatgaacaggacaaagcaaagaggcaattgtagactccaagtggaaaggggacggagaggatgcgggtcaggctaggctctcagctctgtaaaccgaaaccagaaggacaaataagcttagacagattatagtgagagtgggaagctggttcaggaagaggaaggtctgcaaattgtgggtaggatgaaaggaggaggagggagcattggagaagttaagcagagatccaatcatgaacagtctgatgagctacagagacattcggacttactccatgaatcatttaagccttaaaacatgttgagcgtattttttttttttttgagacggaatttcactcttgttgcccaagctggagtgcagtggtgtggtctcagctcactgcaacctccgcctcctgggttccagcgattctcctgcctcatcctctcaagtacctggtattacaggtgcctgccaccacgcccagctaatttttgtgtttatagtagagacgggtttcaccatgttggtcaggccagtcgtgaactcctgacctcaggtgatccacccacctcagcctcccaaagtgttgggattacaggcgtgaaccaccgcacctggccgtgagccaccgtgtctgtccgagcatcttttaatgtttgtcatttagatttcttcttgtgctgaagtgtttgtcttttgctgtttcttttttttttcctagttctttgtcatttgtgtgtgatataaatgtcttctttcacaatgagttctttcatttagtttatggctttgttgttgttgttgaataatagaggtctcactttgttgcccaggctggtgttgaactcttgctctcaagcgatcctcccacttcagcctcccaacctgttgggattacaagtgtgagccaccacacccagccttatggcatctttcgatgaacaaattattgattataatgtggaatttgtccttttattttctctgtggttagtgtttctataggttttatttaagaaatccacagggaggctgggtgcagtggctcatgcctgtaaacccaacactttgggaggccaaggcaggccaacatggctagaccctgtctctccaaaaaataagaaaattagccaggcatggtggcgtgtgcctgtagtcccagcttcttgggagactgagatgggaggatcgcttgagtccaggaggttgaggctgcagtaagccaagagatcatgccatgcactccagcctgggtggcagagtcagaccctgtctgccaaaaaataaaataaaagttggtgaaaatgttgattatatattttaggaacaactagtaattgacatcaaaattatgggctaaagagaaagcaaaaataatgtgattttaaaccagaattcaaaagatctgtttagcgtatgtttagacaaagccattacttattatatcaaagttttaacatttattttgtgagctgtcagcttttcctcttaacatttttccccaccgtcttaaaaaaccccaagaataccggacatttaagactcacttaaagctttaaaagcacttgcaaaatcctaaaatcataatttaaggtgtttttggagggcaggagcaatggtggcaggcagtgttttgctttgttgcccaggctgaagtacagtggcagatctcggttcactgcaccctcgacctattcggctcaagtgatcctcccacctcagctttctgagtagctgggaccccaagtgcacaccaccccatgcctggctaatttttaaatttttttgtagaaacaaggtctcactgtgtagcccagatggtctcgaattcctgggctcttaagagatcctcccaaagtgctgggatcataggtgtgagccaccacacctggcctattttggcattcttgaaaaccgcaggattaccacggataaaattttaaaattacctttaaagaattcaggtttacacacaaaaaaaatttggtttgttagcagtgagtgaagaaaaattttgagaaatgtttaaaatttttagttttgttacacaatacattttactacctgtttaattatcttttttgactcagaaaccagtttcctgggtccaggatgtttagtggtactctttttcttcaagctttttagcattggaggaactgcatattagtaaaatttttagtcttagcattttatagcttactgctatttcttttctttcattctttctttcttttttttttttttttttttttttttgagatggagtctcgccctgtcacccaggctggagtgcagtggcacgatctcggcttactgcaacctctgccttccaggttcaaatgattctcctgcttcagcctcccgagtagctgggattacagatgcccgccaccatgcccagctaatttttatttttttagtagagatggggtttcaccatgttggccaggccagtctcgaactcctgacctcgtgatcaacccgccttggcctttcaaagtgctgggattacaggcgtgagccaccgtgcccagcctttttctttttctttttctttttttttttttttttgagacggagtcttgctctgttacccaggctggagtgtagtggcatgatctgggctcactgcaacctccacctcccgggttcaagggagtctcctgcttcagcctcccgagtagctgggattacaggcgcctgccaccatgcccagctaatttttgtatttttttagtagagatggggtttcgccatgttggccaggctggtcttgaactcctgacctcaggtgatctgcctgcctcgtcctcccaaaatgctgggattataggagtgagccactgcgcccggcccagcatactgctatttctttctttctttcttcttccttttttttttttttgtttttttttttttttttttttttttgtgagacggagtctgtcgtccaggctggaatgcagtggcgttttcttggctcactgcaacctctgctgcccgggttcaagtgattctcctgcttcaggctcccaagtagctgggattataggcctctgccactgcacttggctaatttttgtatttttggtagagacggggtttcaccatcttggccaggctggtcttgaactcctgacctcgtgatccacctgccttggcctcccaaagtgctgggattacagacctgagccaccgcacccggcccatactgctatttcttaacagcagagaaattatgtgtcagattctgtaagtgtaatggtatataaaggataaaatgatgttgaaaaacaaaattttttgtttaaatgcttatgtttctaatattttatttcagaaaggaatttatttcaaaactgataatggttggatccagcttttcacacaaacttttttttcctagtgaggatgcacatttatcctgtaaacaaatggaagacattatttttttaattgcttgcttagaaatgaaataattcttttctaatgatcttttaaagcatgagacctcatacatcatttaaaacaatttatactgtattttacacatgacaaagttctaaggtaacagcccttttctaagactaaagttacagtcctccctttgtatctgagggggattggttgcaggacccccctgtgaatacccaaatccttggatgtccaagtcccttatgagatgtagtatttgcatataacctatacacatcttcccctgtactttatctctagattacgtacaatacctaatagaatgtaaatgctttgaaattagttgttcagctgtattttaaattttgtattttttttcctttttttttgagacagagtcttgctctgttgcccaggctggagtacagtacagtgatcacagctcactgcacctttaacctcccaggctcaagctgtcctgcctcggcctccccaagtgttgggattacaggtgtgagccatcatacctggtcactgttttttattggttttaaatttttgatttaaaatttttaatctaggttggttgaatctggactggaacccaaggatatgtttgttgagcatactgtatttactttggaatacaactagaatgcttaacttgtatgttaaaaatactttatttggccaggcgcggtggctcacgcctgtaatcccagcactttgagaggccaaggcgggtgaatcatttgaggtcaggagtttaagacgagcctggccaacatggcaaaaccctgactctacaaaaaaaaggtaaaaataagccaggtgtgatggcgtgtgcctgtagtcttggctattcaggaggctgagacacaagaatcgcttgaaccggggaggcacgttacgccctcagttgttgacttgagtttttccgtagtttgtagggggagggtaatagagtattaggtagcttttggaatacataggagtgtaactggaaaaagattccaagcaagtctaatgaattagataatttacctaattagtaaattatgtaatcagtatgctttataataatattgtgagttagatcctgtttctgatatgtacataccatattgtataggtgctactaatttggagagcatatacagtgagtccatgcctttttcctgccatcagcattataccaaaattctgccatggtttttaaactttgattctgagaaagtttctcaccctaataacataactatatttgtgtttgtcttcatagttaaatatgcattatgatatcagcttgcatacattttttaaatgacttgaatatctgactttaaaaattattctagaatttctgtgcttcaatattaatgccagaagacttggaattgtttatttgtaggtaactgcctttaaggaaacttgaccaaatattaactaagttatgtatttccttttggcaacagttgtgacttctcaccaggagatttggtttgggccaagatggagggttacccctggtggccttgtctggtttacaaccacccctttgatggaacattcatccgcgagaaagggaaatcagtccgtgttcatgtacagttttttgatgacagcccaacaaggggctgggttagcaaaaggcttttaaagccatatacaggtaagagtcactactgccatgtgtgtgtgtttgtgtgtgtgtgtgtgtgtgtgagagaaacagacagacaggcagacttttttctatatgatgaaattaagtgtattttaccccagtaaattgcaaggggtggcagttgtgaaagcttctggcatgggaaagggatgtaacatggtctttagctggtttgttttgtggaatggaatttttatttctgtcctttgagtgacttacagcaatattatacccttaataagggtaaactaaactgtccccccatcttgaagggtccaagagaaagttaatgtcatcaggatacatagcctatagatagcgacattctctagggaaagatggagatgcgcactacctggccttcaaactactcactaatgaacacatctgagttgagtttcacaccaaactcctggaaccataactttcttttcccagatctagtcttgtttatcacagacatcaacagcctggcatgtttagcctcacttgggctaggtgcaccccatcgtctcttgtacaagttctctttctttcttttttttttttttttttctggagacagagtctcactctgttgcctaggctggagtgcagtggcgcaatctcggcccactgcaacctccgtctcctgggttcaagagtttcctacctcagcctcccgagtagcttgggattataggcacacgccacgttgcctggctatatatatatattttttttttgagacggagttttgctcttttggcccaggctggagtgcaatggcgcaatctcagctcactgcaaccgccacctcccgggttcaggtgattctccttcctcagcctctaaagtagctgggattacaggtgcacaccaccaagcccagctaattttttatttctagtagagatggggtttcaccatgttggccaagctggtcttgaactgctgacctccagtaatccacccacctccccctaccaaagtgctgggattataggcgtgagccactgtgcccagccgcccagctaatttttgtatttttagtagagacggggtttcaccatgttggccaggctggtctccaacttctgacctcaggtgatctgcccatttcggcctcccaagagtctccagtctagtacgttgtcgtactcggtgttgtaaaatccaaacaagggtcagtttcccaggtaactgggaaattcccagaatcacactctttcgtcatagtgctcatcctacaaaaaaggattgggggcattttgtctaaaattaaatgtaaatggtgatctgacatacaggtggaaagagaattgggaagttttgttctctcttctaccaacttgccacataatcttggccaagcaaagtaacttgttttttcttttaatctttttaaaagaaatagagacacagttttgccatgttgcccaagctggtctcaaactcctgcctgagctcaagcagtctgcccacttcggcctcccaaagtgctgagactacaggcataagccaccatgcccctgggctcggccaactttttcgttttcttttcaagagatgggggtctcactctgtcacccagcctggagtatagtgttgggatcatagctcactggagccttgaactcctgggctcaagtgattcccccctgttttagcctcctcagtaaccgggactagaggtgtctgccaccacacctggctaatttttatatagttttttttttttttttttttttttaaagagatgacggtcttgctatgttgcccccagggtggtcttgaattcttggcctccagtgatccttctgcatcaggctcccaagtagttgggtgatctggctaaagtaacttattttctgatactgtttacttatatttagaatgaatctcattggggttgcactggggccgggcatggtggctcacacctgtaatcccagcgctttggaaggccaaggcaggtggatcacctgaggtcaggagttccagactagcctggcaaacatggtgaaatcccgtctctactaaaaatacaaaaattagctgggcatggtggcacatgcctgtaatcccagctacttgggaggctgaggcaagagaatcgcttgaatctaggaggcggaggttgcagtgagtcaagatcatgccaccgcactccaacctgggtgacagagcgagactgtctcaaaaaaaaaaaaaaaaaaaaaaaaaaaaaggctgggcacggtggctcgcgcctgtaatcccaacactttgggaggcccaggcgggtggatcacgaggtcaggcgttcgagaccagcctgaccaagatggtgaaacactgtctctactaaaaatacaaaaataagctgaaatcccagctactcgtgaagctgaggcagagaattgcttaaacctggtaggcggaggttgcagtgagccgagatcgcgccactgcactccagcctggggaacggagtgagacttcatctcaaaaataaataaataaataaataaataaaataaaataataaataaagtaaaaagatctctcattgaaccagatgatatatgaagtctcttttaggaccaatttcgagatttaaaaaatttggcagaattactttttttttttgcagcggagtccagctttatcacccaggctggagtggaatggcacaatctcagctcactgcaacctctgcctcctgggttcaagcgattctcctgcctctgcctcccaagtagctgtgattataggcgcccaccaccaggcccagctgatttttgtatttttcagtagagttgaggtttcaccacgttgtccaggctggtctcaaactcctgaccttaagtgatccgtccaccttggcctcccaaagtgctgggattaggtgtgagccactgggctggcccagaatgatttttaaaaagagatcagtaaggccaggcagtggtggctcacgcctgtaatcccagcactttgggagactaaggtaggtggatcacctgaggtcaggagttgcagacaagcctggccaacatggtgaaaccctgtctctactaaaaatacaaaaattagccaggcatggtgacacatgcctgtaatctcagctactcaggagggtgaggcagaattgcttgaacccgggagtcagtttcttttttctttttttgagatggagacccactttgtcacccaggctggagtgcaatggtgcagtcttggctcactgcaatctctgtctccggggttcaagtgatcctcctgcctcagtctccttagtagctgagactacaggtgtgcaccaccacacctggctaatttttgtatttttaggagagatggatgtcaccatgttggccaggctgatctttaaactcgtgacctgaagtgatccacccgccttggcctcccaaaatgctgggattacaggtgtgagccaccacgcccagccctaaagttgtattttgatggaacgaactgttttgagaaataaattttaacgcgttgagtctgaactgggctgccctttcaaaatgtgaaggccccttaaagtagcacattggttggttattcttttatttatttagatatatctgatctagttgtctttgggacaaactcatatttaatatcatagctgcatgtaactgacagtgtagtctttgtcttcctgaagtgtttgtttgttttttgagatggagtcttgctctgtcgcccaggctgaagtgcagtggtgcgatcttggctcactgcaacctctgcctcccgggttcaagtgattctccttcctcagcctcccgagtagctaggactacaggcatgtgccaccacacccagctaatttttgtatttttagtagagatggggtttcaccatattggtcaggttggtcttgaactcctgacctcgtgatctgcctgcttctgcctcccagagtgctgggattacaggtgcgagccattgtgcccagctagtaagtttttaagaaagattctcaaacctcttttaaatcgtctgcctcacttgaagaggtatgccctacctgtttagggctgtagacccaggtcattagaagacagactaagtagtcctgggtgaacccatagggcaccttcaaggaggtaaaattggtgattttagtttcaccagtagtttttccctgaatatttattccttttgtgctttattgatctatctatatcaataaaaagtaatggggcataacaaattatacttgtcattcttgttcattagggcaaatgttgtaggttgagtcaagtgtccagccaacaagttattttatgtgtgtgtgtgtgtgtgtgtgtgtgtatacatatatacatttttttttttttttttcatcgagacagggtcttgcactgtcgcccaggctggagtgaagtggtgcaatctcggctcactgcaacctctgcctcccaggtttaagtgatcttcccacctcagcctcccaagtagctgggactacaggcgcacaccaccacccttggctaatttttgtattttttttttggtagagatggggtttcaccacattgcccaggctggtcttgaattcctgacctcaagtagtccgcccacctaagcctcccaaaatgctgggattacaggcgtgagccaccacacctggcatatatatattttaagatagagatggggtttgctatgttgcccaggctggtcttgaactgctgggattacaggcgtgagcctctgcacccggcccttattgtttataaatacatttctttctaggttcaaaatcaaaggaagcccagaagggaggtcatttttacagtgcaaagcctgaaatactgagagcaatgcaacgtgcagatgaagccttaaataaagacaagattaagaggcttgaattggcagtttgtgatgagccctcagagccagaagaggaagaagagatggaggtgggacacggcaagcattcagttgttatttatgttagggtgatgggggaagaaagggggagggtgtattaacaagataccttgttttatatatgtgtgtgtatatgtattattttattatacatacatgcatacttctgtagttccctggactgtaggataagttaggttacttagaatctcaacagctagcatcgtttttacttaggttttcaagcctactggcagggtaagcaagaggtagtaccattttggtaagaagtagagagctagggacagtaaagatggagtaatatatatatgagggtatagtcaggccctagaaattaattatccagttttatgctttttataaaaaaactgagatggggtcttgctatgttgcccaggctggtctcaaactcctgagttcaagggatctgcccacctgggcctcccaaagtgttgggattacaggcatgagccacagcacccagccccagctttatgcttttaattctaaaactttttttgttgtattttgcattcataagaatagatgttaaataaaccttgaaatacaaccttggctcaaacgttaatggtcatggataaagtgaattaaaacttgttaggggccaggtgtggtggttaatgcctataatcccagcactttaggaagctgaggcagttggatgtcctgaggacaggagttcaagaccagcctggccaacacagtgaaaccctgtttctataaaaaatacaaaaattagctgggcgtggtggcacacacctgtagtcccaaccacttgggaggctgaggcatgagaattgcttgaacttgggaggcagagggacttgggaggcagagggtgtagtgagccaagatcgcaccactgcattccagccagggtgacagagcaagaagactgtcaacaacaacaaaaaatgttatagaagtgaaaaaaattgattaatttagaacaagcttgtccagtctgtggcccaggatggcgtttaaatcagcccaacacaaatttgtaaactttcttaaaacattttgtgatttgttgttgttgtttagctcatcagctatcattagcattagtgtattttatgtgtggcctaagacaattcttccagtgtggcccagggaagctgaaagatcattatcctctgatctatcatattaatgagctgcatcctaaaagacattcatctataactaagctcagtttcatgttttgttcctttttcaatagataagatagggaatgagcaagttaataaagtgggtattttaattttaaggttgaaactaaggatcataacattatcagaggtctagaactggatggcagctacagagatcatttagcctaatactggtttaacaaataatccgggagatccgtgatatgtgaatgtgctaggcctgagatgagacagccaattgtggaagagcaaacactagaaccagtataagttgcttactgctttcttatgctattaatgagcatatcgcctcctgatatttatgatatatggtcatgccaacagctttgtcataaatagaactcccatggcagcaatcacttaatcttgtagttagaggtggggtctcaccatgttgccgagctggccttgaacttctgggctcagcgattttctccacaggcacctgctactgtgctcggtgcagcactttgtgtttttgaacataacctcaagatgttattgtcttcatagtaaaacaaaagatgaggcttagaactggatcactttgcctgtctcttcttacctcctcccagttcaaaatgcttgcatctcttaatagctagcattcccttggattttgcacatgagctcaaactcaagcctcagcacaatcttttttatagttttagtcttttagccagagtcgacttaccccccatacccactctgcttccttcataatgctgctttccctgggcagagaatccttgcccttcttgtattatgtcactttgtggggttggtgtctgctacacttacagcaagtccagagattttttttccaccacgtttgcaggagaactattggcatggaaaatgacaattgttttaatgtcaagtgaaactgaagttgatgttcattgagaggtttctaatttctagaggtgggttctttttttggcatatgaagttgcagcatattaagagaatttacagtagtacagatggggttatcccatccacaacttatgatggggttacataaactaaaaacgtgtttaatacacctaccccaccgaatattgtagcttgggcgtagcctaacctatctcagacgtgctcagaacacttaaatgttagcctaaagttgggcaagatcatctaacacaaagcctattttataataaggaattgcctatctcatgtaattcatcgaatactgtactaaaaatgaaaaacagtggctgcacgggtaccattataaagtcaaaaaatcataagttgaactgtcttacattatggttttccaaattttgatttgtttttaaatactctttccttgcctggcaggtaggcacaacttacgtaacagataagagtgaagaagataatgaaattgagagtgaagaggaagtacagcctaagacacaaggatctaggcgaagtagccgccaaataaaaaaacgaagggtcatatcagattctgagagtgacattggtggctctgatgtggaatttaagccagacactaaggaggaaggaagcagtgatgaaataagcagtggagtgggggatagtgagagtgaaggcctgaacagccctgtcaaagttgctcgaaagcggaagagaatggtgactggaaatggctctcttaaaaggaaaagctctaggaaggaaacgccctcagccaccaaacaagcaactagcatttcatcagaaaccaagaatactttgagagctttctctgcccctcaaaattctgaatcccaagcccacgttagtggaggtggtgatgacagtagtcgccctactgtttggtatcatgaaactttagaatggcttaaggaggaaaagagaagagatgagcacaggaggaggcctgatcaccccgattttgatgcatctacactctatgtgcctgaggatttcctcaattcttgtactcctgggatgaggaagtggtggcagattaagtctcagaactttgatcttgtcatctgttacaaggtggggaaattttatgagctgtaccacatggatgctcttattggagtcagtgaactggggctggtattcatgaaaggcaactgggcccattctggctttcctgaaattgcatttggccgttattcagattccctggtgcagaagggctataaagtagcacgagtggaacagactgagactccagaaatgatggaggcacgatgtagaaagatggcacatatatccaagtatgatagagtggtgaggagggagatctgtaggatcattaccaagggtacacagacttacagtgtgctggaaggtgatccctctgagaactacagtaagtatcttcttagcctcaaagaaaaagaggaagattcttctggccatactcgtgcatatggtgtgtgctttgttgatacttcactgggaaagtttttcataggtcagttttcagatgatcgccattgttcgagatttaggactctagtggcacactatcccccagtacaagttttatttgaaaaaggaaatctctcaaaggaaactaaaacaattctaaagagttcattgtcctgttctcttcaggaaggtctgatacccggctcccagttttgggatgcatccaaaactttgagaactctccttgaggaagaatattttagggaaaagctaagtgatggcattggggtgatgttaccccaggtgcttaaaggtatgacttcagagtctgattccattgggttgacaccaggagagaaaagtgaattggccctctctgctctaggtggttgtgtcttctacctcaaaaaatgccttattgatcaggagcttttatcaatggctaattttgaagaatatattcccttggattctgacacagtcagcactacaagatctggtgctatcttcaccaaagcctatcaacgaatggtgctagatgcagtgacattaaacaacttggagatttttctgaatggaacaaatggttctactgaaggaaccctactagagagggttgatacttgccatactccttttggtaagcggctcctaaagcaatggctttgtgccccactctgtaaccattatgctattaatgatcgtctagatgccatagaagacctcatggttgtgcctgacaaaatctccgaagttgtagagcttctaaagaagcttccagatcttgagaggctactcagtaaaattcataatgttgggtctcccctgaagagtcagaaccacccagacagcagggctataatgtatgaagaaactacatacagcaagaagaagattattgattttctttctgctctggaaggattcaaagtaatgtgtaaaattatagggatcatggaagaagttgctgatggttttaagtctaaaatccttaagcaggtcatctctctgcagacaaaaaatcctgaaggtcgttttcctgatttgactgtagaattgaaccgatgggatacagcctttgaccatgaaaaggctcgaaagactggacttattactcccaaagcaggctttgactctgattatgaccaagctcttgctgacataagagaaaatgaacagagcctcctggaatacctagagaaacagcgcaacagaattggctgtaggaccatagtctattgggggattggtaggaaccgttaccagctggaaattcctgagaatttcaccactcgcaatttgccagaagaatacgagttgaaatctaccaagaagggctgtaaacgatactggaccaaaactattgaaaagaagttggctaatctcataaatgctgaagaacggagggatgtatcattgaaggactgcatgcggcgactgttctataactttgataaaaattacaaggactggcagtctgctgtagagtgtatcgcagtgttgggtaagactttgaacaagcttgttctcaggctttgataagtagtgctgtttgccagctgtatattatccctaaaaataagtaataaggtatatatggtacatattttgacatgcatatacatatttgcatcctgactaggctgcccacagcaatttaagttacttgaaactcgcttttatcttagtagccctttggcctttcttcagtttttttttttttttttttttttttgagacatggtcttgctctgttgcccaggctagaatatggtgacacaaccatggctactgcagcctcgacctcccaggcttaagtgatctttccacctcagcctcccaagtagctgagattacagatatgcaccaccatgcatggctaatatttaaatgtttgtagagagatggggtctcactgtgttgccaggactggtcttgaactcctgggctcaagtgatcctcctgcctcggcttcccaaagtgctgaggttacaggcatgacccattgcgcctggccctttcttcagtctttaataatcgaacaaaaggtttttgtttttagacagtgtcttgctctgttacccaggacagacctctcgtgtcagcctcttaggtagctaggatttacaggtaagcaccggcgtgccctgctttatttttttggtgggggaagggggaagggagttgaagcttccctatgttgcccaggctggtcttgaactcctggcctcaagtgatcctccagtctcccaaaagtgctgggattacaggcatgagccaccgctcccggcccaaaagatttttaaatgtgttatacttcatgagacaggctttattttagatcgaattttatttatcaataaaaagttgagctttttattatttggtgaatactgtttcaaggtgctttgttacactatctgttgatccaacatttaaaaattgttttattacaacctttgcatttcagtgaatccatctgcatacaattttaaaagaatcattccttttttctgtagccaaattgtcaaagattctttcctacaattgatttttcaaagccctgagttaggaatttacaatttggcaaccatctcaacttcataagcaattttgttctttaaatgtcacggccaacattacctggaaccattgctgttttatagtttaggtttatgttgtatattttttttaattttttagagacggggtcttgctgttttcagactggagtacaatgggatgactagctcactgcagcctcaaactgctgggttcaagtgattctccttcctcagcctcctgagtagctgggactacaggtggtcaccatcacacctggctaatttttgtatttttggtagagacagggtttttcccgtgttggccaggctgttcttgaattcctgacctcaaagcgatctgcccgccttgatctccgaaagagctgggattacacgcatgagccactgcgcccagccctgttttttttttttttttttttttaaataatggtagtttacttgaatttgtaacacagtaacacaaaactattttgatctgaacgcaagtatctaatggaacagaataatatacttccttttagtgtgctgcatttggttactgggtaatttaaaattcttcctcagcacaggtgttcaaaaaccagtcttcagagattgttttcatatcagtgtgccaactttggcacattctgctaagtaagaggcttaagtgtagcatgtttctgctgttttgtgtttgttttgttttgttttttgagacagagtctctctgtcgcccaggctggagtgcattggtgcgatcttggctcattgcaacctctgcctcccaggttcaagtgattctcctgcctcagcctcctgcgtagctgggattacaggcatatgccacgtgtattaggcactgctaatttctgtatttttagtagagacgaggtttcaccatgttggtcaggctggtcctgaactgctgacctcgtgaactctgcccgcctaggcctcctgaagtgctgggattacaggcgtgagccaccgtgcctggcctctgctctatcttttagctttcccttggcacttctatggtccagatgttagagggtaagtattttgatgggggagatcgttggactgtaattgaaagttatgtcttataatgaaatgtgttatataaagaagacctataaaacacttaggctgataaaacccccaaacgatgaagcctcacttttaccctctcttttaacagatgttttactgtgcctggctaactatagtcgagggggtgatggtcctatgtgtcgcccagtaattctgttgccggaagataccccccccttcttagagcttaaaggatcacgccatccttgcattacgaagactttttttggagatgattttattcctaatgacattctaataggctgtgaggaagaggagcaggaaaatggcaaagcctattgtgtgcttgttactggaccaaatatggggggcaagtctacgcttatgagacaggtaactgattcttaaagttttgttatcagaaagtcatttgtgacattaggaataacatacttaggtgatcattttccaaacacagttacataaaagtcagccagtgacttaataggaagcaaagggaaattactccctgtgttataaaattgagaattatatttagctgaaacatcgatgcttaatgttaaggggaatatatgttaaaaaggggaaggaggtcagtcattcaggtcatgaggccctttgacttgaattcatttcctcagaaggtaggtatattcatagtgaacaaaaatacaaaggctgtatgaaaagatgaaaatgttacaggtttatccttaaattagactcatttgcagaaatgcaaatgaggtaagaaagcaaatatagttcatgacctctagcaactgttgaaaactgctctttagggatgacatgctggcccttttttttttgttgttgccaaggctgaagtgcagtggcaccatcacagctcactgcagcctcgaactcccaggttcaacccttcctcctgcctcagcctccccagtagctgggactacagatgtacaccatcatgcctagctcatttttaaaaaaattttttatggcattgtatttatcttctctttataaccaggggttgaccagccacagaacttgtaaagttttttatatttttaaaaggttgtaagaaatagtagtagttggctggtccccgctgctctcctgcattatagtatacttctgttcacctagtttgctagagagaggcagtatagtgtgtatagtgatttccaaactttttctttaaatcagaatcacctgaaagaatgtgacaacgtgtaaaaaaaaaaaaaaaggtgcagagattccatcctgacatggattcacttgattggaattgattctaggcatctcagtagttttaaagagctcctaggtgattctattctggccagcgttgagaatcactagggtagtgggttggtaagcaggctctgatgttttaaaggccaggtgaggccctatgcctcttgtctctcttagcctcaactttctccatgttagcaaatggatttcagaacagaaccaacgtacatgtgattgtgaaagttgttttagagtgcctagctcttacgtaagggttcataagaaagacaaaagtttatgaaactgttactaccagtcataaaagaccttttcctccctcattcacaggctggcttattagctgtaatggcccagatgggttgttacgtccctgctgaagtgtgcaggctcacaccaattgatagagtgtttactagacttggtgcctcagacagaataatgtcaggtgagttttttgtttcccacttaagttctcattcagtcatttagatgtgataaaagatatttgcttcttgtatatgagccttttaaatctaatatttgatttttctggtgttactttaaaaacatcactttttaagaactgcatagtctctctctcttttttttttttttgagatggagtttccctcttgttgcccaagctggagtgcaatggcacgatcttggctcactgcaacctctgcttccaggttcaagtgattctcctgcctcagcctctcgagtagctgggattacaggcgcatgccatcacgcccagctaattttttgtatttttagtagaagcggggtttcaccatgttaggctggtctcttaactcctgacctcaggtgatctgcttgcctcggcctcccaaagtgctgggattacaggcgtgagccaccgtgcccggccaataattgcatagtctcttaatgagatttaatcttttataccaatatgtgtagctcatgatagctatataacctagaagatgaatttatgtaatatgatttgcaaaatgagtattcatttgtgatttttttttttttaaggtgaaagtacattttttgttgaattaagtgaaactgccagcatactcatgcatgcaacagcacattctctggtgcttgtggatgaattaggtaagacattaaacttctcatttgaagactatctatcttaaaaacatttgtacaaataactatttttatagaagattatctgaagtacatttaaacaatatgaatgtttttagagcacgcactcaccattgtggcacagaccgatagttggagataaaaggtgatattgtgaaaggtttttgattacccattaattattaggccttacactgtttagttgtaataaaacatttgttatactacggggatgagaacactaataggaggactcaggaagtttatgaccttgagcgatactgtattttctttaaaagaaacctcactccccatgggctgctaagcagactcgtgtagctaaacaaggcctatttatagaatgcttttagacgtggatgtactaaccgatgttgcttttctgtcctagcatttttgttttaattccttttttgttttaattcctttgagttacttccttatgcatattttactttaacaggaagaggtactgcaacatttgatgggacggcaatagcaaatgcagttgttaaagaacttgctgagactataaaatgtcgtacattattttcaactcactaccattcattagtagaagattattctcaaaatgttgctgtgcgcctaggacatatggtatgtgcaaattgtttttttccacaaattcggttttttgagagggcacttctcttgctagcacatgtatcgctaatatttttctttcttaaggcatgcatggtagaaaatgaatgtgaagaccccagccaggagactattacgttcctctataaattcattaagggagcttgtcctaaaagctatggctttaatgcagcaaggcttgctaatctcccagaggaagttattcaaaagggacatagaaaagcaagagaatttgagaagatgaatcagtcactacgattatttcggtaactaactaactataatggaattataactaactgaccttaagtttcaaagaaacagtaaaaggggaagggatgatgcactatgaaaaaacaaaaaaacttttttttttttttttttaattttaagggaagtttgcctggctagtgaaaggtcaactgtagatgctgaagctgtccataaattgctgactttgattaaggaattatagactgactacattggaagctttgagttgacttctgacaaaggtggtaaattcagacaacattatgatctaataaactttattttttaaaaatga

SEQ ID NO: 34 - DNA, 12 bp, Homo sapiens
ccccgccccgcg

SEQ ID NO: 35 - DNA, 166188 bp, Homo sapiens
accagtcttaacatggtgaaaccctgtctcttctaaaaatataaaaattagtggggcgtggtggcctgcacctgtagatgcaattacttgggaggctgaggtaaaagagtcacctgagcctggggaagtggaggcttcagtgagctctgatcataccactgcaatccagcctgggcgacagttagaccctgtctcaaaaaaaaaaaaaaaaaaattaaaaaaagaatttatcatgaacagttaatacacgcacatggttggaaacaaaggatactgttaaaacagtttcagctgggcgcagtggctcacacctgtaatcccagcactttgggaggccgagttgggtggatcatgaggtcaggagatcgagaccatcctggctaacacggtgaaaccccgtctctactaaaaatacagaaaaattagccgggagtggtggcaggcgcctgggaaggctgaggcagtagaatggagtgaacccaggaggcggagcttgcagtgagccgagatcacaccactggagtccagcctgggcgaccgagcgagactccgtctcaaaaaacaaacaaacaaacaaacaaaaaaagtttcttagacaaattgattacaattgcatatcaaattttaatttcaagcttatttcctttccaagcaggctaaatattcctcttagacattttgtaaaaaagaagcatattagaatcatcagtattagcctggagaaagcaaacaatgtctggaattattagctatcttctaagtctagttaaaggtaactgtcttgtgccaagactgacagtgagctaaatgaactgtttttttttgagacaggatcttgctctgctgcccaggctggagtgcagtggtgctatcatagctcaatgcagccttaaacacctggacttaaggaatttttccacctcggcctcccaaggattacaggtacatgcctggctggttttttaaacttttttttttttttttgagacagaatcttgctctgttgcccccactggagtgaagtagtgtgatcttggctcactgcaacccccacctcccgggctgaagctatcctcctgcctcagcctcccaagcaaatagaactacaggcatgtgccaccaagcctgactaatttttgcatttttagtagagacaaggtttcaccatgttgctcaggctggtcttgaactcctgagcttaagcgatcctcccacctcagcctaccaaagtgctggtattacaggcatgagtcgctgtgcctgccttacagttttttgtagagatgagatcttgctatgttgccaggctggtctccaactcctgggctcaagtgctcctctggcttcaagtcttctaaaatgttgggactacaggcatgaggtaccatgcctggccagctcattaaagtgtatcagaaatggtagtagcttctctaaagggatagcacatgacatcagactataatactcaggtttgaggctgggtgtggtggctcacacctgtaatcccagcactttgggaggccgaggtgggcggatcacttgagatcaggagttccagaccagcctggccaacgttgtaaaactcatctccacaaaaattacaaaaattagccaggtgtgatggtgtgcacttgtagtcccagctatttgggaggctgaggcaggagaatcacttgaaaccagggcgggtggaggttgcagtcagccgagattgtgccactgtactccagcctgggagacagagcgagactctgaaaaaaataaaaatataaatataaaataaataaaactcaggtcagaaacacatcttctttctcagtatacagtcttgctgcagattctgtaagcacacagacggttaagcatacagaatctggaagaagactggattctagatctatcacttactagctctgtgatctggcgcaaggccaggcaattgaattttaatctgtaggcccgagatttctttctttttttttttctatggagacggagtctcgctctgtcgcccaggctggagtgtaatggcgtggtctcggctcactgcaacctctgcctcccggattcaagcgattctcctgtctcagcctcctgagtagctgggattacaggtgcctgccaccatgccagggtaatttttgtatttttagtagagacggggtttcaccatgttggccaggctgatcttgacccgctgacctcggcctcccaaagtgctgggattacaggcgtgagccactgtgcccaccagagatttctaaattgagctgattgtcaggaacatccagggagctttcaaaaatgattccaggctgaggctgggcggggtggctcatgcctgtaatctcagcacttggggaggccgaggtgggtggatcaccggaggttgggagtttgagaccagcctgaccaacttggagagaccctatctctactaaaaatacaaaaattagctgggcgtggtggcgcatgcctgtaatcccagctactcagaaggctgaggcaggagaattgcttgaacccaggaagtggaggttgcagtgagctgagattgtgccattgcactccagcctgggcaacaagagcgaaactccatctcaaaaaacaaacaaacaaacaaacaaaaaacaaaaccaaaaaaaaaaaaaatgattccaagctgggcatggtggctcacacctgtaatcccagcactttgggaggccgaggcgggcagaacaggaggtcaagagatcgagaccagaccatcctggccaacacagtgaaaccccgtctctcctaaaaataccaaaattagctgggggtggtggtgcacacctgtagtcatagctacttgggaagctgaggcaggaggatcgcctgaacccgggaggcagtgagccgagattgcgccactgcactccagtgtggtgacagagccagacttcctctcaaaaaaacaaacaaaggttccaaggctctactccagaaattaagacccattatgtgtgggctgggcacaggaatatgtttaaatccccccccacctccccagggtgattctgctgctgaattaggttttggaaccacttccatggggaaagggtaaactaaactggagaatgcaaaaaccttttttttttttttttttttttttgagacagagtctcaccctgttgcccaggctggagtgcaatggcgcgacctcggctcactgcaacctccacctcccaggttcaagggattctcctgcctcagcctcccaagtagctgggattacaggtgcccaccactacacccggctaattttgtgtgtgtttttagtagagacggaggttcaccatgttagtcaggctggtctcgaactcctgacctcaggtgatctgcccgcctcggcctcccaaagtgctgggattacaggcgtgagccaccgcgcccggccagcaaaaaccttttctaagagttaattttgcaggatggatcctgagctccttcaggtgtttgataacattttatttattttttgagacagagtctcgctctgtcaccgaggctggagtgtagtggcgcgatcttcgctcactgccccctccacctcccaggttcaagagattctcctgcctcagcctctcgagtagctgtgattacaggcgcccaccactatgcccggtaatttttgtatttttagtagagacggggtttcgccatgttggccaggctggtctcaaactccggacctcaggtgatccacccgcgttggcctcccaatacgctgggattacaggcgtgagccactgcgcctggctgtttgctaacattttaaaatttcaaccttcctcttccttaactggtcttcccctaccccccctcaagacggggtctctcgctctgtcgccccagctgcggtgcagtggcgtgaacatagctgacggcagaagacctcctgggctcaaacgatcctcctggctcgtgctcccaaagtactgggattatggcgtgtgacaccacgcctggcgtcaaacgtttgtctttttatttattttattttgtattttttgagacagggttttcaatctgtcgcccacgctggagtgcagtggcacaatttacggctcaccgcagcctcgacctcccgggctcaggtgatcctttcgcctcagccctgctaatatctgggatcacagacgtgggttttaccatgttgcccaggatggtgtcaatctcctgggctcaagtgatccgcccacctcggcctcccaaattgctgggattacaggcgtgagctaccgcgccctgccacaaacgcatatcttctaacgtaccatttcatttacttgctatattcattatctgaattttctcatattagaatgtaagcagaataaaggcagtgatttttctttttactggcgatcctcagagccaagaagagtctgggacatagcaggccatataaatgttttcgaatgagtgaatcatcaacgagtggatgaaacgataatgtggctaacaggcagcagtaaggaggctgtgtagaataaacccgtaatcccgatgttggcagtttgcttagaaagaaaaagggaggcagtcggagaggggcacacgttttaacaaaatactgggaggaggaggaaggctagttttttttttgttttcaagtttccttctgatgttactcccatgcttccgggcacattacgagctcagtgcctgccggaaatctcccacctggtggcaacctacccttgcatacaccccacccaggggcttcaagccttgcagctgagtaaacacagaaaggagctctactaaggatgcgcgtctgcgggtttccgcgcgacctaggcgcaggcatgcgcagtagctaaagtcaccagcgtgcgcgggaagctgggccgcgtctgcttatgattggttgccgcggcagactcccacccaccgaaacgcagccctggaagctgattgggtgtggtcgccgtggccggacgccgctcgggggacgtgggaggggaggcgggaaacagcttagtgggtgtggggtcgcgcattttcttcaaccaggaggtgaggaggtttcgacatggcggtgcagccgaaggagacgctgcagttggagagcgcggccgaggtcggcttcgtgcgcttctttcagggcatgccggagaagccgaccaccacagtgcgccttttcgaccggggcgacttctatacggcgcacggcgaggacgcgctgctggccgcccgggaggtgttcaagacccagggggtgatcaagtacatggggccggcaggtgagggccgggacggcgcgtgctggggagggacccggggccttgtggcgcggctcctttcccgcctcagagagtgggcggtgagcagcctctccagtgcggaggcacgggggcggaacgttggtgcttgtgcggattccgccgtccccaggttctgcttggctccggagggacgcccccctcagccctgaaacccgtgcctctccagccgccccggatctgaacttgtgatcacggagtgtttacgtcgtgccaggcattttaatgcattgttctagttcattttccagcagtcgcattcctcgccttggccctacatgtagcgctcattacaaacacggccagaatctcttattaacaaacagcagccaggagtgagatttaaaatagactgggggtttaggagacccttttatgacacgtaattctgctcccacgacgctcccatttataccgccggtccagctaagggtctggtaatggagcgccgttgaagagcagtatgatgaagtggtcaggaccaacggactctggagctgggctgcttgggatcaagtcgctgcccctctgcttattaacgtgtgaccttgggccagtcatggacgctatctgcttcagctcagcattcagtgctctccgtcacccgaccccatctatccaggattatctctccctggaaagctacaaacgtctcaccctatgtgggccaaatgttctggataggcctagttaacctcttctctccctgttttctttgcgctttcttgcagctatgtagttatgctaatgaaaagagcatcctagggggagcagagttgtggattctagtcctgactagaggactagtgcaaatgcgatactcctgatgaaaaatgtttcattcgttagatataaatgtgttaggcagggttatggacactagatgaaaaaagaaatacctctactttcatagagatcactattggacagcaaggcagaaataattacaattcaagttggaggcttatggaggtgagcttgtaagaggttacaagaggcgccaaggcaggatcgccaaagacggaagactttggaagagtctcatacaacggaagaggcgttatatgagacaccaaagtccacgttgagtcttggtggactagaagtttgctagggagagggcttgaaacgaggtagattggcgttgctggtgtagaaaaggaaggagactggcccaggtgggtggggttagatgaccaaaggcttttagtgtggtgttgagctgttgaaattttatgctgtagccaatgaaaagtctgaaatgttttttttttttttttttctgagacggagtcttactgtgtcgcccaggttggagttcagtggtgtaatcctggctcactgcaacctccacctcctgggttcaagcgattctcctgcctcagccaccggagtagctgggattacaggcacgtgccaccacgcctagctaatttttgtatttttagtagagatggggtttcaccatgttggccaggctggtctcaaactcctgacctcaagtgatccacccaccttggcctcccgatgtgctgggattacaggtattagccactgcacctgacctacatagattttacataagactttaaaacagggcgggcgcagtgactcacgcttgtaatcccagcactttgggaggctgaggtgggcggatcacaaggtcaggagatcaagaccatcctggctaacatggtgaaaccctgtctacactaaaaatacaaaaatcccagcactttgggaggctgaggtgggcggatcacgaggtcaggagatccagaccatcctggttaacactgtgaaaccctgtctctactaaaaatacaaaaaattagctgggtgcggtggcaggtgtctgtagtcccagctacttgggaggctgaggcaggagaatggtgtgaacccggaaggcagagcttgcagtgagccgagattgtgccactgcactccagcctgggcaacagagcgagactccatctcaaaaaaaaaaaaaaaaaaaaaaaagactttaaaaaaaattataagaaaggacagaccaagtgcagtggttcgttccagcacttagggatgccaaggtgggaggattgcttgatgctaggagttgaagactagcctgtgtaacatagcgagacccatctctacaaaaaaattaaaaagttacctttagaacttacgatttttatgtgtagactccatataagcagagggtctatgcttattcactatttattaccttccatagtccctgcacatataataggtgcttcataaacaatttaatgaatgaataaattactgagaaaacactggaagtttttgggttagcattgtgttaggtgcttgatatggtctggctgtgttcccacccttatctcatcttgaattcccatgttttgtgggaggtacctggtgggacataattgaatcatgtgggcaggtttttcctgtgctgttctcctggtagtgaataagcctcacaagatctgatggttttaaaaatgggagtttccctgcacaggctctctctctttgcctgccgccatccatgtaagatgtaacttgctcctccttgccttcctcaatgattgtgaggcctcctcagccatgtggaactggctgcagagtcattaaacttcgttcttttgtaaattgcccagtctcaggtatgtctttttttatttttttttgagacagagtctggctctgtggctaggctggagtgcagtggtgcgatctcgactcactgcagcctccgcctcccgggttcaagcgattctcctgcctcagcctcccaagtagctgggactataggtgcacgccaccatgcccagctaatttttgtatttttaatagagacggagtttcactgtgttggccaggatggtcttgatctcttgacctcgtgatcttcccgcctccgccttccaaagagctgggattacctacccagctgggtatgtctttattagcagcgtgaaaacagactaaaacagtaaactgataccaatagagtgggatgcagctgaaaagatacccgaaaatatggaagcaactttggagctgggtaacaggcagaggtcagagcagtttagagggctcagaagaagaccagaaaatgtgggaaagtttggaacttcctagagacttgttcaatggctttgaccaaaatcctgataatgatatggacaatgaaatccaggctcatgtggtctcagatggagatgaggaacttgttgggaactggagcaaaggtgacacttgttatgttttagtaaagagactggtggcattttgccctgccctagagatttgtggagctttgaacttgagagaaatgattttgggtatctggtgggagaaatttctaagcagcaaagcattcaagaggtgacttgggtgctgttaaaggcattcagttttaaaagggaaacagcatgaaagtttggaaaatttgcagcctgacaatgtgatagaaaagaaaatcccgttttctgaggagaaattcaagctagctacagaaatttgcataagtaatgaggatcccaatgttaatccccaagacaatgggaaaaatgtttccagggcatgtcagaggccttcatggcagcccctctcatcacaagcctagaggcctaggagaaaaaagtgatttcatgggccagcccggggtccccatgctgtgtgcagcctagtgacttggtgccctgcatcccagctgccccagctgtggctgaaaggggccaacctagagctcaggccatggcttcagagggtgcaagcctgaaaccttgacagcttccaggtggtgttgagcctgcaggtgcacagaaatcaataattgaggtttgagaatctctgcctaggtttcaaagatgtatggaaacgcctgcatgtccaggcagaagtttgctgcaggggtggggtgctcattgagttcctctgctagggcaatgtagaagggaaatgtagggtcagagcccccccacagagtccctactggggcaccacctagtggagctgtgaaaagagggctaccattctccagacctcagaatggtagatccacagacagcttgcaccatgtgcctggaaaagctgtagacacttaacgccatctcatgaaagcaaccaggcagtgtgctgtaccctgcaaagccacaggggcagagctgtccaaggctgtggttgcccagctcttgcatccgcatgacctggacatgagacatagagtcaaaggagatcattttggagctttaagatttgactgccatgctggattttggacttgcatggggcctgtagcccctttgttttggccaatttctcccatttggaatggctgtatttacccaattcctataccccattgtatctgggaagtaactaacttgcttttgatttgacaggctcatatgcggaaaggacttaccttgtcttgaatgagactttggactggaattttgaattaatgctgaaatgagttaaggctttgggggactgttgggaatgcatgattggttttgaaatgtgaggacatgagatttgggaggggtcatggcagaatgatatggtttggctatgtccccacctaaatcccatcttgaattcccatgtattgtgggagggacctggtgggagatagttgaatcatggggatggatctttcccatgctgttgtgatagtgaataagcctcatgagatctgatggttttaaaaacggaagtctacctgcacaagctctttctttgcctgctgccatccatgtaagacatgacttgttcctccttgccttctgccatgattgtgagacctccccagccatgtggaactataagtccagtaagcctctttttcttcccagtctcgggtatgtctttatcagcagcatgaagtccagctaatacagtgcttgaacatgtaatatctcaaatctgtaatgtactttttttttttttaaggagcaaagaatctgcagagtgttgtgcttagtaaaatgaattttgaatcttttgtaaaagatcttcttctggttcgtcagtatagagttgaagtttataagaatagagctggaaataaggcatccaaggagaatgattggtatttggcatataaggtaattatcttcctttttaatttacttatttttttaagagtagaaaaataaaaatgtgaagaatttaattgtgttttagtattttaagtagattgtgatagtagaatggtttgagacactttaatagcaattagcatgtggtttttaaaaagttgcagtttggctggtcgcagtggctcatgcttgtaatcccagtattttgggaggctgaggcaggtaggttgcctgagcccaggagttcaagaccagcctgcccaacgtggtaaagccccatctctactgaagataaaaaaatttaaaaaaattagctggggctattggcacacacctgtggtcccagctaatcaagaggatgaggttagaggatcacttgagcccaggaggttgaggttacagtttaactttcagaggccaaggcaggaggattgcttgagtccaggagtttgagaccaccctggggaatgtagggagatcccatctctatagagggatagattagatagataatttctgaggggaggggagggggagggccagggaaggggagggaaaggggaggggagggcagggccagcagtaaggtcataatagagacatgtatctgtaagatccttataataggtgaggatggccacaaattagcgccacagatttgtatttttagtagagacaaggttttaccatgttggccaggctggtcttgaactcctgacctcaagtgatccgcctgccttggcctcccaaagtgctgagattacagatgtgagccaccatgcccaaccacaagcatttatttatttatttatttatttatttatttatttatttagagacagtcttgctctgtcgccaggctggagtgcagtggcgccatctgggctcactgcaaactctgactccctggttcaagcttttctcccgcctcagcctcccgagtagctgggattacaggtgcatgctgcaacacccggctaatttttgtatttttagtagagatggggtttcaccatgttggccaggacggtctcgatctcctgacctcgtgatccgcctgccttggcctcccaaagtgttgggattacaggcgtgagccacagcactcagccagttatttttttataagaaaacattttactggccaggcctggtggctcacacctgtaatcccagcactttgggaggccgaggcaggcggatcacgaggtcaggagttcgagaccagcctggccaacatggtgaaaccccatctctactaaaaatacaaaaattagccaggcgtggtggtgtgcgcctgtattcccagctactggggaggctgaagcaggagaatcgattgaacccttgaggcagaggttgcagtgagttgagatcgcaccattgcactctagcctgggtgacagagcaagacttcatctcaaaaaaaagagaaaacattttattaataaggttcatagagtttggatttttcctttttgcttataaaattttaaagtatgttcaagagtttgttaaatttttaaaattttatttttacttaggcttctcctggcaatctctctcagtttgaagacattctctttggtaacaatgatatgtcagcttccattggtgttgtgggtgttaaaatgtccgcagttgatggccagagacaggttggagttgggtatgtggattccatacagaggaaactaggactgtgtgaattccctgataatgatcagttctccaatcttgaggctctcctcatccagattggaccaaaggaatgtgttttacccggaggagagactgctggagacatggggaaactgagacaggtaagcaaattgagtctagtgatagaggagattccaggcctaggaaaggctctttaattgacatgatactgtttcatttaaggaaaaataataaaaaaactcttttttttgtatctaattaaaataatgttctgatgtttacagaaactttgtatatttaattggacattagaacaagctgtttgttgtgtaagatttattttacctcagatcttttctcccccctttcctttctgtcttgtgttccaaaagagtaattattacggtaaatattactgtaattatggatttatcaaataagatgcagttctttagcattttttgataaatcgagtggaactttagcctgttattttactatttgttttattttaactaaattctgattgtgtcattttttttttttttttttgggaccgagtctcgctctgtcgcccaggctggagtgcagtggtgcgatctcggctcactgcaacctctgcctcccaggttcaagcaattcttctgcctcagcctcctgagtagctgggattacaggtgtgtaccaccacacccagctaatttttgtatttttagtagaggtgaggtttcaccatcttggccaggctggtcttgaactcctcacctcgtgatccacccacctgggcctcccaaagtgctgggattacagccatgagccaccatgctcggctttgattgtgtcatttgtataggcatgtggtttattatttagttatttttttttttttctttgaggtggagtatcactcttggtgcccaggctggagtgtaatggcgtgatctcagctcactgcaacctctacctcctgggttcaagcaattctcctgccccagcaggagtagcttgggattacaggcatgccccaccacacctggccaattttgtgtttttagtagagacagggttccaccatgttggtcaggctggtcttgaactcctgacctcaggtgatctgcccacctcagcctcccagagtgctgggattataggcatgagccacggtgcccagcatatttagatttttttttttttgagactgagtctgactctgtcacccaggctagagtgcagtggcacgatccacgatcttggctcactgcagcctccaccttatgggttcaagcgattcttctgcctcagcctcccaagtagctgggactgcaggcacatgccaacacgcccggcttatttttgtatttttatagagacggggtttcatcatattggtcaggctggtctctaactcctgaccttgtgatccacccgccttggcctcccatagttctgggattacaggcatgagccacagcgccaggcctagatgtttcttaaggtatgtatctcccaaagattctttttgtggtcctcaagtaccataagcaccgctggagataacacatgtgatgggcatttttagcatagattgtatctaagcaactttccacaagtaatagttctgttaagggttgttattgtggccgggcgcggtggctcacacctgtaatcctggcactttgggaagctgaggcggccggatcacctgaggtcagggattcgagaccagcctgtccaatgtgctgaaaccctgtctctactaaaaatgcaaagaaaaaaaaaatctagccaagcatggtggcttgctcctgtaatcctagctacttgggaggctgaggcaggagaattgcttgaacctgggaggcagaggtagcagtgagccaagatcgtgtcaccgcattccatcctgggcgacagtgagactctgtctcaaaacaaaaaaagagttgttaccgttgggactattttttgaaagctttatgtgaacgtaattttatattttgatgaaaatttagtttattgatgtaaaaagtgtatcagtacatcatatcagtgtcttgcacattgtataaacatttaatgtaggtgaatctgttatcactatagttatcaatgttataattttcatttttgcttttcttattccttttctcatagtagtttaaactatttctttcaaaatagataattcaaagaggaggaattctgatcacagaaagaaaaaaagctgacttttccacaaaagacatttatcaggacctcaaccggttgttgaaaggcaaaaagggagagcagatgaatagtgctgtattgccagaaatggagaatcaggtacatggattataaatgtgaattacaatatatataatgtaaatatgtaatatataataaataatatgtaaactatagtgactttttagaaggatatttctgtcatatttatctcaaaacctaaactgtgtatcaatgatattaagcttttttttttttttgagacagagtttcacttttgttgcccaggctggagtacaatggcgcgatcttggctcaccacatcctctgcctcccaggttcaagtgatcctcctgccttggcctcctgagtagctgggattacaggcatgtgccaccacgcctggctcatcttttttgtatttttagtagagatggggtttctctatgttggtcaggctggtctcaaactcctgaacctcaggtgatccgcccgcctcgggcttccaaagcgctgagattgcaggcatgagccactgtgtctggcctatttttatagtttatgtacttggaattatataatatattctgcctagcttctttcattcaatatttgtaagatttatccatattattgagtgtagttgtggatttttgcatttatatttcatagcacgagcatgtcagaatttatccattttacttcccttctgcccgccactgctactctccccattttacctttttttttgtttttttgagatggagtctcagaatttcgctctgtcgcccaggctggagtgctgtggcacggtctcagctcactgcaacttctgcctctgggttcagctgcacgccaccatgcctggctaatttttgtattttcagtagaggggattttgctatgttggccaggctggtcttgaactcctgacctcaggtgatccacccaccttggcctgccagagtgctgtgattacaggcgtgaaccaccgtgcccgacccccattctaattttgatggacatttgggtaattttcatttttggctgttataaatactgctgcaattacagttaattttcacagtttttttttttttttttttttttttttttttttgaggtgagtttcgctcttgttgctcaggctggagtgcagtggtgcgatctcagcccactgcaaccttcaccttctggattcaagcaattctcctttctcatctcctaagtagctggggtttacaggcatgtgccaccatgcccagctaatttttgtattttaatttcacagttctggaggctgggaagttcagaattaaggcactggctgatctgttgtctggtgagggcccacttgttcatagataaccattttctcactctaacctcacaaggttgaaagggcctaatttttgtgtttttagtagagacggggtttcactatgttggctaggctggtctcaaactcctagcctcgagtcatccacccgcctcgtcctcccggagtgcttggattacagcatgagccactgcgcccggcccccattttagttttgatggacatttgggtaattttcttttttggctattctaaataatgctgcaattactgttaattttcaccttgtaaaaaccattttcaaatctcaagagattaacctttagttttcttggtttggattgggaaggaacaccaaggaaaatgagggacttcagaatttattttcattttgcatttgttttttaaaatctttagaactggatccagtggtatagaaatcttcgatttttaaattcttaattttaggttgcagtttcatcactgtctgcggtaatcaagtttttagaactcttatcagatgattccaactttggacagtttgaactgactacttttgacttcagccagtatatgaaattggatattgcagcagtcagagcccttaacctttttcaggtaaaaaaaaaaaaaaaaaaaaaaaaaaagggttaaaaatgttgaatggttaaaaaatgttttcattgacatatactgaagaagcttataaaggagctaaaatattttgaaatattattatacttggattagataactagctttaaatggctgtatttttctctcccctcctccactccactttttaacttttttttttttaagtcagagtctcacttgttccctaggccagagtgcagtggcacaatctcagcccactctaacctccacctcccaagtagttgggattacagttgcctgccaccatgcctggttaatttttatatttttagtagggttgcggggacagggtttcaccatgttggccaggttggtctcaaacttctgaccttaggtgatcctcccacctcggcttcccaaagtgctgggattacaggcttgagccatcgtgcccagcctactttttacttttttagagactgggcttggtggagtgaagtggcaagatcatagctcactgcagtattgaactcctgggctcaagcgatcttcctgcttcaacctcatgagtagctgggtctacaggcacaagccaccatgcttgcctaattttaaaatttttgcagagttggagtttcacagtgttgcccaggatgttcgctcactcctgacttcaagtgattcttctgccttagcctctagagtggtagctgggattacaggcatgaaccaccatgctctgctattttttttcaaggtttttttttttttttttttttttgagagactggtatgactatgtatgctccctaggctggagtgcagtggctattcacaggaagtgccatcagagtgtactacagcttcaaactcctgggctcaagcacttctatcatagtctccaaagtagctgggactacgagtgtgtctcattgtgccttgctctcgaattgctttttttttttttttctggtttcaagctatctatgtggtattagtcctcactttatgaataattttgtatactactaatagcaattttttttttttttttttttttgagacggagtctcattcttgtcgcccaggctggagtgcagtggtgtgatcttagctcactgcaacctctgcctctccggtttgggcaattagctgggattagaggcgcctgccaccatgcccagctaatttttgtatttttagtagacatggggtttcatcttgttggctaggctggactctaactccaggtgatctgcctgcctcggcctcccaaattgatgggattacaggtgtaaaccactgggcctggcctagcaatttaaaatgacattctaagaagttttatgtctaaatctgcagtaagtggctgggtgacgtggctcatgcctgtaatcccaacgctttgggagtccagggtgggaggatgacttgaggccaggagttgagaccagcctgggcaacatagtgagactctgtctctacaaaagaaaaaattagcggggcttagtggcgtgcgcctgtagtctcagctactcgaaaggctgaagtgggaggattctttgagccccaagggttctggcttgccgtgagccaggatggcaccactgcactccagtctgggcaatagagtcagaccctgtctcaacaaataaaataaaactgtagtaattataaagtggttttggctgggggagaaatgtacagttgaacatacggattaagaggttgaaagttggtcttaggaagaggaactttttgtggaaatttcttaatatttgaagaatattatgttattgttcctctgtttttcatggcgtagtaaggttttcactaatgagcttgccattctttctattttattttttgtttactagggttctgttgaagataccactggctctcagtctctggctgccttgctgaataagtgtaaaacccctcaaggacaaagacttgttaaccagtggattaagcagcctctcatggataagaacagaatagaggagaggtatgttattagtttatactttcgttagttttatgtaacctgcagttacccacatgattataccacttattgtaatatgcagttttggaagtatatgttaccatttaactgtacagagtacatagtaatagagtggtaattatttagattgattaaagaactcatttttttaaataagttttttttttttcactataaaagtttattttatttgagatggtatggtatcgaacatgttcatattgtgtgtaatcgtgggtaaattactcaacctttatgtcatagtttcttcacctttaaaatgacattaataaaagagctacttaataggattataagcatgagatgatttaatatacataaaatacttacagtctgatatataggaagcacttaactctttatcctagaaaagatttaaggtgaccttaacatatatgtcagaaaatctttaaaattgtggaaataaaaggttgtataattctgctatcctaaaattactagtatttcaatatattttattttagtcttttcttttagatacaagttttaaaacttttaagtgaagtgtaatatacgtaagtactgcttgatgaatttaaggtgatttctaaagccaggtttgttggggaagaggagtgggatttagtgatttagaaccagaaattggggctgggtgcgatgtctcatgcctataattccagaacttcgggaggccatagtgggagaattgtttgtgccccggagttcaagaccagcctgggcaactcagtgagacgccatctctacaaaagaaaaaaaaaaaaaattagctcagtgtggtgacatgtacctgtagcccgagctactcgggaggctgaggtgggaatatcaccctggcccagaagtttgaggctgcagtgggctatgattgtgccactgaactccagcctgggcaatggagtgaaaccctgtctcaaaaaacaaacaaaaaaagaaactgaggctgggcacggtggctcacacatataatccagcacttggggaggttgaggcaggataattgcttgagcccaggagtttgagaccagtctgggcaacaaaatgacaccccatttctaccaaaaaaaaaattgtttaaaattagctgggcatggtggcatgtgcctgtggtcccagctacatgggaggctaaggctggaggattgtttagcccaggaggttgaggctgcagtgagccatattcatgtccctgcactccagcctgggtgacatagtgagacgctgtctcaaacaaaaatcaacaggccagatgcagtggctcacccctgtaatcccaacactttgggaggccgaggtgggtggattacttgaggtcaagagttcgagaccagcccggccaacatggcgaaaccccatctctactaaaaatacaaaattagatgggcatggtggtgtgtgcctgtaataccagctactcttgaggctgaggcatgagaatcgcttgagttgggaggcaaaggttgcagtgagccaagattgtgccactgcactctaccctgggtgagaaacgagattttgtatcaaacaaacaaacaaacaaaaaaagacgcccaaaatcaacaacaacaaaaacgatattggaatgattggatccccaaagataaatgtttgaggtgatggatatctcagttaccctgagttaagtattatacattgtatacgtgtattaaaatattacaaacccccaaatgtgtacaattatgaggtatcaataaaagagattggaaggactgggtaatttgcaagtaattaaggcaatttacaatttttaatttttatttgtgaataagtagttatacgtgtcaaaattcaaaaaggacaggtggatatacagtgataagtcatccccccttctctgtcagctccataaagagcccctgtcttgcatggctccagggtcacatttcctattgtattttgccaccacctgccctgggagcaacagtgttagtttcttgaacatccttccaagcagagtctgggcctacacaagcaaaacaagtatgtctattctctctcctctttaatttttttaaaggaagtgattgataatttaacactcaagctataggtcattggttatatttttaatttccaatttatgggaatagaggaagtgtcagtgatccccttctggtttaagaactggaggatgcatgtgtttagaccctttagaaacctgaaatgtcacctaatataattatcagagtaacactttttagtaagcaagctatctatcaaaagtaggtttttgaagaagagggtaaggaaaggttactttcatgggacatagcaataatttctaaaatctaatggttttacaagacttgttcattagaagtaacatctgtgaggatggctttatgagtcaaaatattatctgcttaataccccacctgtagggtaagaagaaatgtttttttcttggtgacaatttttagcagcaagcggggagggcctgtggcttccaaggccaaacgttgaaataccacagactaggaagaaaaagatccactccttatacaggatttgtttgtttcttcttttttcttcatttttgtagagatgaggtctcactatgttgcccaggctggtctctcttttttttttgagcccgagtttcactcttgacgcccaggctggagtgcagtggtgtgattttggctcaccgcaacctctgcctcccgggttcaagcgattctcctgcctcagccttcctgagtagctgggattacaggcatgcgccaccacgtccggctaattttgtatttttagtagagatgggtttctccatgtgggtcaggctgctctcgaactcccggcctcggatgatccacttgcctcggcctcccacagtgctgggattacaggcgtgagccactgagcccagccatgctggtctcaagcaatccacacccacctcagcttccaaaagtgctggcattacaggtgtgagcccccgtgcccagcctgtttcttataattattcctctttctcaactctgtctgctgtggtacctcatgcttcctagtttaagccttcttgggagttctcaggagaaatctgttatctcccttactaagcatttgggattgatgttccttccaggttactataaaaccaagttttttttggttcttttttttttttcttttaaaagaaatgagattttgtcatggttagcctggtttcaaactcccaagctcaagtaatccaccttcctttgcctcccaaagtgctaggattacaggcatgaaccactacacccgatctgtactgttcctctttccattcactaaaacctacttgcaactatgagcatatgttattgccatctagaaatgagtttctagggacttgttcctttttgtactttatttaaacagtcgaattagaaattattattatcattatttattttttgagatggagtcttgctctgttgcccaggttggagtgcagtggcgtgatctcggctcactgcaacctccacctcctgggtttaagcgattctcctgtctcagcctcccgagtagctgggactacaggcatgtaccaccacacctggctaatttttatattcttaatagaaacagggtttcactattttggccaggctggtctcgaactcctgacctcagatgatccactcaccttggcctcccaaagtactggaattataggcgtaagccaccgtgcccggccaaaattatttataataagcaaggcatggtggcttgtgcctgaagtcccagctacttgggaagctgaggcaggaggatcacaggttcaggtccaccctgggaaaatagtgagaaccttccctatccccagtcttcaaaaaagaaaaaaatttgctggagaaggtcacacaatgctgataggtcccattgtgctttcatgctttctagttttcaatgataactggttgttacttttattgtctgactcattatagtgaccaactcccgattttttactttgccttaagccttcagctatctcctacctctaagcggatgatttcttccttaacacttaaaacctcaaaatttatctgtacttccactcttttactctctggctctttctcagaagaagaaataacacttttatttcttttcaaagccaacctttccatactttacttggagacatatttctttttttttgttttgtttttgtgagtggagtctcactctgtcgcctggtctggagtgcaatggcgcaatctccactcagtgcaacctctgcctcccaggttcaagcgattctcctgcctcagcctgctgagtacctgggcttacaggttagcacaccacacccggccaagttttgggtttttagtagagacagggttttgccgtgttggccaggctggtctctaactcctgacctcccgatccgcccgcctcaggtgcaagccaccgcgcccagccctagtgtagcaatcttaatcagaaatatgtctctggctgggcgaggtggctcatgcctataatcccagcactttgggaggccaaggcaggcagatcacctgaggtcaggagttcaagaccagcctgaccaacatggagaaaccctgtctctattaaaaatacaaaattagctgggtgtggtggcatatgcctgtaatcccagctactcaggaggctgaggcaggagaatcgcttgaacctgggaggcggaggttgcggtgagccaagatctcaccattgcactccagcctaggcaacgagcaaaactccatctcaaaaaaaaaaaaaaaaaaaaaaagattgctatgttaatcttatttatttatttatttattttgagacagagtctcacactattgccagggctggagtgcaatggcataatcttagctcactgcaacctccgcctcccgggttcaggtgattctcctgcctcagcctcctgagtagctgggattacaggcgcccgccaccacgcctggcttattttttgtgttttttagtagagacggggtttcactacgttggccaggctggtcttgaactcctgaccttgtgatttgcccacctcagcctcccaaagtgctgggattacaggcgtgagccaccgtgcctggcttatgttaatcttattttatataaaaagaaataatattaaactagaaggcaataaaaatgccaaattcaatacacaaattattttgtcagcatttccacaagaataaactattttatatgctaacatatgttcaatgttccttacagaattctgacattaaaaatgaaaaattaccaaagcttcagatgaatctataaatggacaaaagaaaaagcttaaaaggataaagagcaacactccaagtgcatgtataaacataaggactcttgggacttaacctttttaaaaatctttaggcctagcacagtatttgctatttaatgtatcaaatgggtggttttgacttcattaatccatatataggacagatgaaaaaaagaattatagacttgtaattacagttctttaggaaccatatttgctctcagccttttaaatacgctgtcaggcaattccagtcagcacttttgaaaaaaacctacctacctacctacctacctatctatctatctatctatctagagactgagttataagactagctagtttttgtattttttgcagagacaggatttcatcatgttttctaggctgttcttgaactcccaggctcaagccatccacccgcctcagcctcccaaagcgctgggattacaggcgtgagtcaccatgcccaaccaattccagtcagctcttaaaatgaaagcctagaaatggtagggttaaagaggggacagaatgttgattttaaaatacctagaatttggccaggtgcagtggctgtaacccagcactttgggaggccaaggtggccggattgccttggcctgcctcagcctcccaaagtgctgggattacaggtgtgagctcaggagttcgagaccagcctgggcaacacggtgaaaccccttctctagtaaaatacaaaaaattagctgcatgtggcggcgtgcacctgtggtcccagttacttgggaggctgaggcaggagaattgcttgaacctgggaggcagaggttgcagtgagctgagattgcgccactgcactccagcctgggcaacagagtgagactctgtctccaaaaaaaaaaaaccccaagaatttgattaattctgttggaattttaagagttaactgatccccaaaatgactcagctgtatgcaatttaatgcaatattaattcgcatgttgactctcagaattgcatacagctgagtcattttattgagtaggattgataagtatactatgttatgccaacagtaactgtgatgcttctaaaattgtgatttttaaattggcattgtcacagaaacagcagagtagttgtttttttctttaagcttcttttagccagaaacataaactgaaactgtaattattactgcaatcgtatgttgaatagacttgtgaaactagcaatttattaggcttttaatgatatctggaccaaaggctgagggagctgtgctgtgtgtatgttgctttgtgctttgttttttagaagcttgtcgtttctttgccattttacttctttctttttttttgagacggagtcttgctctgtcccccaggctggagtgcagtggcgcagtttccgctcactgcaagctccgcctcctgggttcactccattctcctgcttcagcctcccaagtagctgggactacaggcgcccaccaccacgcccggctaattttctgtattttttagtagagatggggtttcaccatgttacccaggatggtcttgatcttctgaccttgtgatccgcccgcctcggcctcccaaagtgctgggattacaggcttgagccaccacgcctggcccattacccattacttgtttcttaatgttacattctctttccctctttttttttttttgttttttgagatggagtttcgctcttgttgcccaggctggagtgcaacggtgccattttggcccactgcaacctctgcctcccaggttcaaatgattctccagcctcagcctcccaagtagctaggattacaggcacctgccaccacgcccagctaatttttgtatttttagtagagatggggctttgccatgttggccaggctggtcttgaactgctgacctcaggtgatctgtctgcctcagcctcccaaagtgctgggattacaggtgtgagccactgcacccagtccttaatgctactttataggtgaaaattgtgaaataacttaaatttcattttaattaaagttaatttttgggaaattaacgaaaggttgacattttattcttttgaatattgcagttgttatttgggtttaaattggggggcttaggaaggaaagaagcctgatggttgtttctgaattttctgaaaattatgtttgatatgctgtatatgaaatccagcttggagagaatatgtccattgttaaggaaaaattaatgaagatttgatctagataaggcattccaatcatttggaagtggtttgagtatctttttttctttttttaatttgagacagagtcttgctctgtggagtgtagtggtgcaatcttggctcactgcatcctccacctcccgggttcaatcaagcaattctcctgcttcagcctcccgagtagctgggattacaggtatgggctaccatccccagctaatttttttttttggatggaatcttgctcccgtcgggcaggctggagtgcagtggtgtgatctcagctcactgcaacctccacctcccagtttcaagcgattaagtgattctccttcctcagcctcccgagtagctgggattacaggcgtgtgccaccacgtcgccaccacgtctggctaatttttgtatttttagtagagacagggtttcgccatgttggccaggctggtcatgaactcctgacctcaggtgatccacctgcttggcctcccaaagtgctaggattacaggtgtgagccactgtgcctggcttaagttttgtatttttagtagagacggtgttccatcatgttggtcaggctggtgtcaaactcctgaccatgcgatccgcctgcctcggcctcccaaagtgctgagattacaggcgagagccaccgtgcccggcctgtttgagtatcttttaaaaccagtaaggacaaactagaggtgtcagctctcttcatgggctttggagaaacaagacaaaaaggaaagagatgtttcgccgggcgcggtggctcactcctgtaatcccagcactttgggaggctgaggacagcggatcacccgaggtcaggagtcaagaccagagccattgcactccagcctgggcaacaagagcacaactttatctcaaaaaaaaaaaaaccaaaaaagaaacaggaaagagatgttttgattttttaagtctagagtgttctgttcttactctacagcacttagcagtagtccatctatcctccttgtttgttctttacaacaaaaccccattggttctctcttaccaagtttgctttattcttggtttatcctttgtaagatgtgaaagggatatgaagagcaaataggaagtgttactcttgctgcttgagagaaagctgttttacaatttgttggcaaacaatttgtaaaagtacaacaaaagtgtgcatttttggcttcttatttatgttttatcattgctatatctcataatttgtgatttttaaaataactttttatttgaaaagcactacagggtcacgtcatgtttttaaaaaataaattaagaaggtaaacacccgtacttctactttacctctagtcctagtctatggtggtaatcagtgttaacagtttagtttgtgttcttacccttccaggggttttttttctctatgtatacagatatatgcatttttaaaaacatagttaacacttaaaaacaatatgggatcgtattaggaatacaatctgtattccttcccaacagtatatacagtttttttccatttcactatgtatctatttataaattttttatttctaataatttctcttgaataggtgagacatcatatagtataaaattcagtagaaaatcagtttttcagaggtacaaaattggctgactttgcacagactcctttcatttcacaggtagggatgcacagccacctcttccaccgacgagaggaaaggatatgtgtgcctgtgggctcttcaactctgttgattagttatgatttattttctggtcagtttgagaggaaacagtgataaaatactgggaacagggaagaagcataagattattattgtttttttttttttttttgagacagagtcttgctcagttgcccaggctggagtgcagtggtgcgatctttgctcactgcaagctccgcctcccgggtccatgccattctcctgcctcagcctcccgagtagctgggactacaggcgcccgccaccacgccctgctaattttttttttgtatttttagtagagacagggtttcaccatgttagccaggatggtctcgatttcctgacctcgtgatccacccgcctcggcctcccaaagtgctgggattataggcgtgaaccaccgcgcccagctttaattttttttttttttttttttttgagacagagtcttgctctgtcgcccaggctgaagtgcagtggcgcgatctcggcttgctgcaagctccgcctcccaggttcacgccattctcctgcctcagcctcctgagtagctgggattacaggcacccgtcaccatgcccagctaattacgggacctcgctctgtcgcccgggctggagtgcagtggcacagtctcgctcactgcaatctggcaagtgattctcttgcctcagcctccagagtagctgggactacaggtgtgcgccgctacgcccagctaatttttgtatttttagtagagatagggtttcgccatgttggttggccaggatggtctcgatctcttgacctcgtgatccgcccttctcggcctcccaaagtgctgggattaccggtgtgagccatcgcacctggccttcctactttattaagatacctaagggatttctgtgattgttaggattcaaatttctgtgagcataagaatcaagctgtgtgcataataattgcatgggatttcacagctgggccccattcccagggattttgtattatctacctccaagtgattttgatgctggtgatccttggaccagacttggtgaagctcaatgcttagctaggaaagccccaaaaatttgctttattggattgtgtaatttgactacatccattgtttcttttttcaaatgtagagttatatgccacaaaaatattttccgtagcagtaggcatcctaattaatctcgatgtttgtttatagccccattgatggggctataaacttggcagcaaattgttttcccactaatttggcattttccataaatgtttgtttatagccccattgatggggctataaacttggcagcaaattgttttcccactaatttggcattttccataaaaaacacgtatctgttgttagctgcctagacgttagctggacatggtttaggttacttttctcttaaaaagtaaattttaattcaagttcctttaagccagcagtctcaacctggggcagtttttccctccaggggacattcagcagtgtctagagacatttttggttgtcatgctgaggaagagagtgtatagtgggtagaatccagggatgctgttaagcatggaacagccccttacaacaaaaaattatgtagcctaaaatggcagtgttgccaagattgagaaattatgctttaaatgtgtttttatatatggccattttgtgtttactctggagataacatgcttttcctcatataacatgcttgataaacattttggtaacacaggaattgtaaatgctggtgatgtcagtaaatagttaagaaatttagggctgtgcgcggtggctcacgcctgtaatcccagcactttgggaggccgaggcgggtggatcccgaggtcaggagatcgagaccatcctggctaacatggtgaaaccccgtctctactaaaaatacaaaaaaatgagccgggtgtggtggcaggcacctgtagtcccagctactcaatttagaaagcagatttgtttcctttctatacctgtgtaatttgaggtttagtttactgtcacatcgtttataaacataaggaagatcgttgctcatctgatagcattccgaaccttgagtcatctgtaatgcctatggcctccagaaaagcttctctaatactgtacttagagatgtgtaaaatatgtaggaacattttcccaccttcgattgttagtttacctttcagcttcagtaatttacctttcagctattactttagtaacatcttcaacattgtttttcaaactgcaaggtgtgacccagtagtgggtcgttaaattagtaggtgacagagcatttttgaagaattaaatacaatagaacatagcagagtgggctcacgcctgtaatcccagcactttgggaggcgaggctggcaggtcacaaggtcggcaggtcacaaggtcagaagatcgagaccttcctggctctaacatggtgaaaccccgtctctactaatagtacaaaaaattagcggggtgtggtggcatgcgtctctagtcccagctactcaggaggctgaggcacgagaatcacttgaatccgggagctggaggttgcagtgagccgagattgcaccactgcactccagcctcagcaacagagcaagactatttcaaaaaaaaaaaaaaaaaaaaagaaagaaagaaaaaaagaaaatagagtgtatcacataattagagtagcaagtattgatttgtgaaacctattttaatcatagatctatgtatgtatgtgctggattgtgatgtaaagacatttcttgctgtggttacactgaaaaaaatgaaaagtcactgatttccaataacttacagaagcagtatgaactacatattctgtcgttcttgaaacaagctgagattttattgactttgggaagcagtagaattattttagttttttaattaacagtttttggctttgtactgtcaagaggtaattttagaaagcattctaaaaatgtaagtactggatttggcaacattcttgaactgtaattctgtttcgttaaacatcactatttacatgtgcaacagcgtgtctgtaacaatgtcccagtaatgaaattctttcttctatttaaggcatgtctgtttgataaaagtcaaacaaaattgggtatatgtcagtgtcttatgatactgcttaattaaacattaatttgactcttagctaatcaggaaatgtttgcctcacagtcttacagagctttccaccttctaaaaaagctaacgtttcagaatagattcaggattcaaccttctttctgtctttttttttttttgtttgagacagagtcttgctctgttgcccaggctggagtacagtggcgctatctcggctcactgcaacctccgcctcctgggttcaagcaattctcctgcctcagcctcccgagtagccggggttacaggcgtgcgccaccatgcccagctaatttttttgtatttttagtagagacagggtttcaccatgctgggtggccaggcgggtctcaaacttctgaccttgagatctgcccaccgtggcttcccaaaatgctgggattataggcgtgagccaccgcacctagcctagattcaggctgcttctttttttttttttttttgagacagagtcttgctcttgttgcccaggctggagtgccatggcatgatctcagtgcaccacaatctctgcttcccaggtttaagcgattctcctgcctcagcctcccaagtagatgggatcacaggcatgagccaccatgcctggctaattttgtattttttgtacagacggggtttctccatgttggtcaggccagtctcgaactccctacctcaggtgatctgcctgcctcggcctctcaaagtgctgggattacaggtgtgagccactgcgcccagcagattcaagctttttaaatggaattttgagctgatttagttgagacttacgtgcttagttgataaattttaattttatactaaaatattttacattaattcaagttaatttatttcagattgaatttagtggaagcttttgtagaagatgcagaattgaggcagactttacaagaagatttacttcgtcgattcccagatcttaaccgacttgccaagaagtttcaaagacaagcagcaaacttacaagattgttaccgactctatcagggtataaatcaactacctaatgttatacaggctctggaaaaacatgaaggtaacaagtgattttgtttttttgttttccttcaactcatacaatatatacttggcaatgtgctgtcctcataaagttggtggtggtgactcactcttaggacacattcagatttcttttttttttttttttgagaaggagtcttgctccgttgccaaggctagagtgcagtggcacaatctcagctcactgcaacctctgcctcctgggttcaagcgattctcctgcctcagcttcctgagtggctgggattacaggcatgtgccaccatgcccggctaatttttgtacttttagttttaccatgttggccaggttcgtctggaactcccaatctcaggtgacccacctgcctcggcctcccaaagtgctgggagtacaggcgtgagccacagagcctggccatgttcagacttctaataacaggtttgtattgactcttagcctcatggcagaagccaagagacatgagacagcttagaaatttttgctttttggaaatgaatgttagagttactggtttgtgattaaggcctattgcactgacagaggcagtgaaaaagggtttgattgccaaggaagattcacagggcctagaatggcagtggttatgcatctacagtttattacaggagaaggatacaatccagtagcaggattatggtaaggatatgcatcacagtcaaaggctgtcatagcaagtcatccagagagttcgggtgcaagttccagttttcctttgttgtgtaaagtctgtggtggggtgcattttctctctcagagcaggatgtgtgcacaggacaccttggaacctaggagcccaaaatagagtcttcactggactttttaatatttttcttgtcaagcggacatgttcctgttctctaactagcctcttcagtggaggtcagaggaagagcctcattgagaccaagtgcaactcatcaatcacatgaaacaatgctgataaataaaccacctaaatatcccctgacccacaaatacaaaacaacaccattcaatcagtatttttcatgccttgatcaggggtcattgccatgcaggaactttaacaaaacagtacaggctaataatagaattgttggaattaactcacacagcacacctatgagagagagttaagatagagggtcttggtggtctctaacagttgaattcaaagtgaagttaccagagtaaagtgagcaaagacacatattagtacaatattggtagataaaatcacgttgctctaataagcatagttttaaactttaaccatgtttctccagtaattttagtaattatattgttgttatgtctaatacataaagcattttttacttttttaaaaaatttttaggcaatgtggggtccaaagtaattaaaaaaaaatttttttaacataaagcatcttaaaattttacttaatcatgatcacttagaaccattaaaacatacgttttgatattatggggaagcttcgttgttcctttgtagacagacttaaagaaatacaactttatgatgacaagatataagataattatagatttaaattttatagaaaccttttcccttatctagtgcaagaggtagctaagtgcttattttctcaaagtactgtgttataaaaagtattcctagtgtagtcaaagcttctctttagactgataaaacttagagcacctgcatttacttccaacaaagcagaattaaagaaaatgagacttggccgggtacgtttgtaatcccagcactttgggaggccgaggcaggtggatcatgaggttaggagatcaagaccattctggctaacatggtgaaaccctgtctctaccaaaaatacaaaaaattagctgacatggtggtgcgcacctgtagtcccagcttctcaggtggctgaggcaggagaatcgcttgaacccaggaggtggaggttgcagtgagctgagatcacaccactgcgctccagcttgggcaacaaaaaaaaaaaaaaaaaaaagaaaaagaaaatgagtctttactggctgggcacagtggctcacacctgtaatcccagcactttgggagaccgagacgggcagatcacctgaggtcgggcattcgagaccagcctgaccaatatggagaaaccccatttgtactaaaaatacaaaattagcggggcgtggtggcgcatgcctgtaatcccagctattcgggaggctgaggcaggagaattgcctgaacccgggaggcggaggttgcggtgagcagagatcgtgccgttgcactccattctgggcaacaagagcgaaactctccatctcaaaaaaaagaaaatgagtctatactttgctgttttcatactctcttagtgtggtgtaggcagccatgtatcccccttgtgcctctatttctccattctgtgaatgagtgtcttccactgctgtgcttttctgattccgtaacctttgtttgtttgtttgtttgtttgtttgtttgttttttattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaatgagcgtgctgccttcaagcatctgtttaacaaagcacatcttgcaccacccttaatccgttcaaccctgagtggacacagcacatgtttcagagagcacagggttgggggtaaggtcacagatcaacaggatcccaaggcagaataatttttcgtagtacagaacaaaatgaaaagtctcccacgtctacctctttctacacagacacggcaaccatccgatttctcaatcttttccccacctttcccccctttctattccacaaaaccgccattgtcatcatggcccgttctcaatgagctgttgagtacacctcccagacggggtggtggccgggcagaggggctcctcactacccagtaggggcggccgggcagaggcgcccctcacctcccggacggggcggctggccgggcggggggctgaccccccccccccgcctccctcccggacggggcggctggccaggcggggggctgacctccccgcctccctcccggatggggtggctggccgggttgggggctgaccccccgcacctccctcccggatggggcggctggctgggcagaggggctcctctcttcccagtaggggcagccgggcagaggcgcccctcacctcccggatggggcggctggccgggcggggggctgacccccccacctgcctccaggacggggcggctggccgggcagagcggctcctcacttcccagtaggggcggccaggcagaggcgcccctcacctcccggacggggcggctggccgggcagaggggctcctctcttcccagtaggggcggccgggcagaggcgcccctcacctcccggatggggcggctggccgggcggggggctgacccccccacatccttcccggacggggcggctggccgggcagagggtctcctcacttcccagtaggggcggccgggcagaggcgcccctcacctcccggacggggcagctggccgggcggggtgctgacccccccacctctctcctggctgggcggctggctgggcggggggatgacccccccatctccctcctggatggggcggctggccgggcggggggctaacccccccacctcccttccggacggggtggctgccgggcgcagacgctcctcacttcccagacggagtggctgccgggcggaggggctcctcacttctcagacggtgtggctgccgggcggaggggctcctcacttctcagacggggcggttgccaggcagagggtctcctcacttctcagacggggcggccgggcagagacgctcctcacatcccagacggggcggcagggcagaggcgctccccacatctcagacgatgggcggcctggtagagacgctcctcacttcctagatgggatggcggccgggcagagacgctcctcactttccagactgggcagccaggcagagaggctcctcacatcccggacgatgggcggccaggcagagatgctcctcacttcccagacggggtggcggccgggcagaggctgcaatctcggcactttgcggggccaaggcaggcagctgggaggtggaggttgtagcgaactgagatcacgccactgcaccccagcctgggcaccattgagcactgagtgaacgcgactccgtctgacatcccggcacctcgggaggccgaggctggcggatcactcgcggttaggagctggagaccagcccggccaacacagcgaaaccccgtctccaccaaaaaaataccaaaaccagtcaggcgtggcggcgcgcacctgcaatcgcaggcactcggcaggctgaggcaggagaatcaggcagggaggttgtagtgagccgagatggcagcagtacagtccagctttggctcggcatcagggggagaccatggaaagagagggagagggagaccgtggggagagggagaggagggagagggagagggaaccttttgttttattccagtaggaccagctagaaacagaaggtgattgaccagtattagggatggaatcagggtacaattatggagacaggctatctaaacaattcactctcaccatttaaatcagctgtttgatcattttttttccatatatctttaccatcgcatagtaaataatatcctttttattttcaagagggagtattggccttaagttaggaactctcttaatttttttcccccatcatcccacccgcacttcttactccttacttcctacttgcttttattctttactggctctttaccactgcgtatttttaggtgcatacatctattttttaaaaaagcacccttgttcctgggtcctcttccagtaccatctattaatatatctctctccctctttccactcccagctgggtttctgaaagcgtgcacttcccatcttccattcattcatctggtttccagccctgaccacagtactgaaatggcatttgctaggtgacctttatttttttttaaatccagtgaatgcggtatagtccccccgcttttttctttctttttttttttttgttttttgttttttgtttttttgagacagagttttgcccttgttgcccaggctggagtacaatggcgtgatatcggctcacggcaacctatgcctccccaggttcaagcgattctcctgcttcagcctcccaagtagctggattacaggcacctgccaccacagctggctaattttgtatttttagtagagatgggttttctcgatgttggtcaggctggtttcgaactcccgacctgaggtgatccacacacctctgcctcccaaagtgctgggattacaggtgtgagccactgcgcccagccttggtatagtctttaacgaaagttcactgatcttgaaaattttgatcttgaaactcttttttttttttttttttttttttttgagatggagtcttgctctgtcacccaggctggagtgcagtggcacaatctcagctcactgcaacctccacctcccaggttcaagcgattctcctgcctcagtctcccgagtagctaggattacaggtgcccaccaccatgcctggctaattttttgtatttttttagtagagatggggtttcactacattggccaggatggtcttgaactcctgacctcatgatccacccacctcggacctcccaaagtgctaggattacaggcgtgagccaccatgcccagccttgaaactctcctaaggttatgttaaacatttttgtattcttggttttctttttgttccatgggttatttctctttatccttctttttagctttcttaagtgttcctttaccttatcaaattctatttttggctcccatttcacttaataagaggaaaagctgggatttttttttttcttttgtggagacagagtctcactttgttgcccaggctggagtgcagtggtgcgatctcagctcactccaacctccgccttctgggttcaagcgattcttgtgcctcagcctcctgtgtagctgggattgcaggcatgtgccaccacgcctggctaatttttgtatttttagtagagatgggggtttcaccatgttggccaggctggtctcgaactcttgtcttccaagtgatctgcctgcctgggcctcccaaagtgctgggataaatttgagccattgtgctcgtctaagctgggattctttgaatgagttcttagaggcttcctgaaactttgtgcaacattttgtgtatgtgtatattttctggggaaaggatttgtaactttctattttttgagagggagtctctgtggctcagggtggagtgcagtggtgtgatctcggctcactgtaacttctgcctcctggttcaagtgattctcctgcctcaggctcccaagtacctggaattacaggcatgtgctaccacacctggctaattttgtatttttagtagagacagggtttcattatgttggccaggctgggaatttgtaactttcatcagatatcccaagggatatatgtctttcctggtagagagggaagaaacaaaaaacgtgtgtaaataccctcctctcccccagaaggtaagaagtactgctctgcacattccttgggtgatctttctcactccctgggataattaaggaagttagggattggggttgagggtaacttggcatccttccccaacctccctgtataggcacagtctaatatacttgatgacagtttgcaacaagtcaacaatttcctacttttctggtgttaggtttaagttatatagacctatggtgatcataacattatctaaatcagatgcttcacattataggtcttgcagctgatgtccagtttaggtgtttgaagtggcttagcctggaaaatgttacaggggaaaatctgctttccatgtgttatgctcagagctgtgttcttttcttttacacaatatgtttgacatttgttgaattttaggtgtaccctggtcattaggaactccctaaaggatctctgtgaggttttaaaaaaacaaaacaaaacaaaaaaacagtggcattttgcagaactcagtatagctctttaccatactgactgcaaggagaaagtaaaaagtgagactaattttgcaattagtctcccaagtttctttacaagaaaatagaccaaaggtactatgtttaaaagcaaaatcatggcttaaaagtttttctttttcttaatatattaatatattgctataaattgagtattgctctcttgctatcttgtgtttttttggtttttgattaactctaagcttaatgttattcctgacaaataaataaataaataaataaataaataaataaagtgaattcagagagacagtagagggcagcagccgtttagaaagtagattcacattgagtgattacggctcttttaaatctttctccactaagagatagctaatttccgaaaaggtatacttggcctcccatattccttatgtctcttaaaactaaaaaagctgggacaaaacttaaaataacagtattctacggttagggcaaatttctgatactgcttaaaacaatttaccgaggtatctttatttttttttgagacagggtttcactctgtcacccaggctggagtgctggagccttgacctcctgggctcagctcaagtgttcctctcacctcagtctgccaagtagctgggactacaggcatgcaccatcattcccaactaattttttaaaattttttgtagagatgggggtttcatcatgttgccaggctggtctcgaactcttgggctcaagcaatctgcccacctcgtcctcccgaagtacagggttataggcatgagccaccactcccagcctcagatttttttattgatgaattttattataacagctacaatactgagatgcataacccttccctttcctgatacccagttatcatctgtttctgtttaatacactccttaagtacctcacatttgctattcccctgccccccatggtctatgcatcttcttcattgaagtggtagtagtctttgttagctcatctggtcatgtcatcaattcagagcacattacctctttagttcagaacacattaattgcttcccataatcttcaggacacggccccatttcttcacgtggcttggccattgcttccctgttcagcttcccccacactccctcacctacaccttctgtctcagtatagtactgctagtctccagacatgccatgcctttttatgcttctatgcgtgttttcctgtctttaatgtccttgtccatgtgatgaacccctactcatttttccaagattgaactcaaatgtcaccttttctgtgagcttctctgctcttctcatgcagagtagaagtgtttatctccattgcccttgaccctaaataacagtacattagtataataatcacattttttacctgtttgtgtgctttccttctaaatggagaataagaatataaaagtgatttatttggcatttctgcaaagggagatgataaaaagaatctgcgttacttagcctttttaaaaaacccttagcctatgaaggctactatttaaggtttggttggattttgtatgttggaaatatgttctttaaatctcatcttcatcagtttataaaagcaatataagttctttgtagatcattatcatgccatccagatgtagtcattattgttttgatataggttgtttcagtctttaaaccaaattatacactgttccgctgtaactcttgttttgaaaacagatttgttccaatgtgggtggtatattagggaacaatttgagcataatgtaaattttgagtttgcttatgcacaaatccctaggcaacactaggtgaatgcagaaaaatgcatgcagctgaactcagcagtgtagatatatacaaaagatacacatacacacgctcttcaaatacctaccttattttcctgtatgtgttatgaaccatacccattcacatctggtattacaactttgccacccatttcagacagtattcctttgaccattctgcagtaactcagaagctgcagccctttagaagtctactccactgtggctcacgtctgtaatcccagcactttgggaggccgaggtgggtggatcatgaggtcaggagatcaagaccatcctggctaacacggtgaaaccccgtctctactaaaaaaaaatagaaaaacctagccgggcgtggtggtgggcatttgtggtcccagctactcgggaggccgaggcaggagaatggcgtgaaccggggaggcagagcttgcagtgagccaagattgcgccactgcactccagcctgggcgacagagcgagagtccgtctcaaaaaaaaaaaaaaagaaaaaaagaaggccactccacaagcaaaccgcagatgttttgcaaggtgacttatttattgtaatagttgtgtatttcttaaccatttcacatgtataaaactgtgctactacttttatgaggttcctgtctttattttttttaacatgtcgctggtgaaggttctgagagttgtggcttgaactccagttttctcataagcacggttttttgttgtttttttttgaaatggtctcgctgtgttccccaggctggagtgcagtggtgtggtctcggctttctgcagccttggcctcccagcttaagctatcctcccacctcaagctatcctcccacctcagcctcccaaatagctgggactgcaggcgtgagcctttgcccacctaatttttatacttttgtagagacagtttttccatgttgccaggctgctttggaactccttagctcaagcaatcagcccgccttcacctcccaaagtgctgggattacaggtgtgtcctaccacacccagacggctctggtatttactgcatagtgttctgatttttaggaatacatacgttgcattatatagcagaactggctgtattcaaaagtctaatagaaaatattgatagggtgataatgtatatagtactaattgtcagttgccataatttaactaatattgttttactttttactttttttttttttgagatggggccttgctatattacctaggctggtcttgaactcctgagctcaaggaatcctcttgcctcaacctcctgaggatgtttgacattttttgacttttttttttttttttttgagacggagtcttgctctgtctcccaggctggagtgcagtggcatgatctcggctcactgcagcctccacctcccgggttcaagggttcaagcacttctgcctcagcctcctgagtagctaggattacaggtgtgcaccaccaccacggctgatttttgtatttttaatagagatggggtttcaccatgttggtcaggctggtcttgaactcctgacctcgtgatcctcctgtgtcagcctcccaaagtgctgtgggtacaggcgtgagcctccatgccggccggctttttggcaatttaaatagttacagttacctattataattgatatttagctaacatctatttttattttaatattccaggaaattattatgcagaaactttaaaggtctgtgtacttctctggtgttttgattttttttttttctttttctgtgagtaattttctaaaactggtttctaggccaggctatttatgtcttgctttttattttttttggcgatggagtctcgctttgttgcccaggctggagtgcagtggcgctatctcatcttgctgcaacctctgcctcctgggttcaagcagttatcctgcctcagcctcccgagtagctgggactacaggcacatgccaccacgcctggctagttttttgtatttttagtagaggtggagtttcaccgtgttgcccaggctggtctggaacttctgagctcaggcagtctgcctgccttggcctcccaaagtgctaggattacaggtgtaagccactgctcccagccttattattttatttttatggattcggggtatatgtgcaggtttgtcccatggatatattgtgtaatggtgagttttggacttctgttgtgcccatgaacattgtacccaataggtggtaatttttcaattctcatccctctctctgcctctgcccttttggagttcccagtatctgttaattctctctgtatgtccatgtgtacccattgtttagctcctctattttttattttattttattttatttttgagacaagagtcttgctgtatcacccaggctggagtgcagtggtgcaatctcagttcactgcaaccttggtctctgggttcagatgattctcgtgccttagcctcccgagtagctggaattacaggtccgtgccacgatgcccggctaatttttgtattttcagtagaggtggagtttcgccatgttggccaggctggcctcaaactcttggcctgaagcaatccgcctgccttggcctcccaaagtgctgggattacggtgtgagccactgctcctgaccccatattttttcttttaattataaaggtaataatgtaaaaagaagtcaactcccagtttaactctagcagagtaaccagtgttaatttttttttttttttttttgagacggagtcttgctctatttcccaggctggagtgcagtgatgccatcttggctcactgcaacttctgcctcctgggttcaagccattctcgtgcctcagcttcctgagtagctgagattataggcgcccagtgccacgcctggctaatttgtgtatttttagtagagatggggtttcaccatgttggctaggctggtgttgaactcctgacctcgtgatccacccgcctcgatgctgggattacaggcgtgagccactgagcctggccaatccattcctttttatggctgagtagtattccattgtgtgtgtgtgtatatatacatatatatacacacatatacatatatatacacgtatatatgtatgtatgcgtatatatgtatgtgtgtgtgtatatatacacatatacatatatatacacctatatatgtggtatgtgtatatatatgtggtatgtatatatatgtggtatatatatgtggtatgtgtatatatatatgtggtatgtgtatatatatatgtatatatgtgtgtatatatgtggtatgtatatatatatgtatatatgtggtatgtatatatgtatatatgtgtgtctgcatatatgtatatgtgtgtatatatacacgtatatgtgtatatatatacgtatatatgtgtatatatacatatatacgtatatatatacacacacacatatatatacacatatgcaggcacacatatatatacatatatatatatacataccacagtttctttatccacttgttgattcatgggcatttgggttggttccacgtttttgcaattgtgaattgtgctgctataaacatccgtgtgcaagtatcttttttgtataatgatatcttttcccctgggtagatacccagtagtgggattgctggatcaactggtagttctacttttaaggaatctccacactgttttccttagtggttatactggtttacattcccaccagaagtgtagaagtgttccctgttcactgcatccacaccaacatctatttttgattttttgattatggccattcttgcaggagtaaggtggtatcgcattgtggttttgatttacatttccctgatcattagtgatgttgagcatttttttatgtttgtttgccatttgtatatcttcttgagaattgtctattcatgtccttagcccattttttgataggattgtttgttttttttcttgctagtttgtttgagcttgttgtagattctggttattagtcctttgtcagatttatagattgtgaagatttttttcccactctgtgggttgtctgtttttgtctgtttccttctgctgactgttccttttgccatgcaaaagctctttttttttgagacagaatctcgctctgtcggccaggctggtaacaaagacacaggtactggtaataactgccatggcttattgcctacattaatgatgaaagcaaatgctaaatttcagctagaggctagagaaaataagcctggaattttcttttatgtttatatactgctatgaataccaggagtccttgggttaagactgtagggctttctaaagcctgtgatcactagtggagaatgtagctttacaaagtctagttggaaattggcaactgggggttagtacaagttacaaggaagggatggaatttaagatgctagtgaaagcttggaggataagggagcaggtgaactcataaggaagtttatgaactgagaagggctgcagcaaagtgggctcatgtgcttgaggagccagaggacatgttgagggtgacataggttctgaagttcgtacagatacttatgcagtatggattcttggaaaaccttctttagtcatgtgatagaaaaataacagcttatggaaaaaacagggttgaggcagacctgaaaatacatgaaattttaaaaaccgcttctaacagaagcataacagactgtaataaaaactgtggccttcctggcatttgcacccaaacaacagcattagccaactctttgaagccttagatctgtggctcttgttttctcctttgaggtgtaggtccttgagggcatttgcttctaatagaggctagtttcatcagaattaaaaatctgaaccatggtatgaaattcaattcttttttttttttcttttttgaaaacactggcaaatgttttgtatccttgagctttcccacatatcttaacatagtgagtggaaagtacagtggctgttaagccaactactctgaggtcttcactgctaaggcttactcttaattgtgtgagagcttaaccttgatccctttaaaacattaatgggctagaaaaaaaaccattcataaaccagtgccacctctgaattttgctaccacaattcccttatttaccaatagtgcatgagctaatttggaataaagaactaggcattgtagcacaacagacattatgtgggcaaagtgttgtttatattctgtctaaatagtgcttcacatgtatgtactattttctaaatatgtatagatgcttttgtgattaataataaaacatgaattcttaaaacaattttgctgacttcatagtagcttttcaccgttttttcagtagctgctaaaatttctggagaagtttgggaactattgttttggagtgaaatgcagtgtgttagatatcacttgcagaattcttctaagggtatttattggcgattagaaaaaaaatccttgtgttataccagtagtaatacaaagtaattgttcagcttctgttaagtgtaaaggactatacaagtattgtgtatagttatctcatttattattttctgggtagctattgttattattacttcgtacaaaaagggaaaaggaggctcaaagtatcatgctccagataacagagccagtaggtagcagagctgggattgctacccaggtctctagtcctgctttttcacactatatactcattgcttcacttactccttcatacatgattccccagcatgtactcttttttttttttttttttttttgtttgagatagaatctcgctctctgttgcccaggctggcaggcagtagtgtgatcttgggctaactgcaacctccatctcctgcattcaagcagttctcctgcttcaacctcctgagtagctgagattataagcctatgctaccacgcctggctaatttttgtatttttagcagagatgaggtttcgccttgttggccaggctggtctcaaactcctgaactcaagtgatctgcccacctcagcctccgaaagtgctgggattataggcatgagccatcatgtccggcctccccatcatgtacccttaaataccatcaagcacagttccattgtgtaaaaacttggcttgatttaacctgttaattggaacactgtcattaatggaaattaggaatatgaggtaagctagaggttttattttaatgactttgggttattaaatctataagaaatgaaattcatttagtcataattaatgtcatgtttctgcatctatattacttgttgggtttacagacgaggtagtgtattattagtgggaagctttgagtgctacatcatctccctttctataaaataaattgagtacgaaacaatttgaattaaaacacctgagtaaatagtaactttggagacctgctgtactatttgtaccttttggatcaaatgatgcttgtttatctcagtcaaaattttatgatttgtattctgtaaaatgagatctttttatttgtttgttttactactttcttttaggaaaacaccagaaattattgttggcagtttttgtgactcctcttactgatcttcgttctgacttctccaagtttcaggaaatgatagaaacaactttagatatggatcaggtatgcaatatactttttaatttaagcagtagttatttttaaaaagcaaaggccactttaagaaagtttgtagatttttctttttagtatctaattgtagcacctttgtggacagtggatgtaatattaagtgacagatgggaaaaggatttttaaaaaaatagcaactgtttcagtggatgaaataaagattattagcagagaaaatgaatattgggcataactgtcctggtgaaagacaatctcataaatgaacaatttcataatttcgtaaatgcaactgcattttattttcaaagagaaggaaaattatagtcactggaaacggaaagagaagttagaggtaaacataggacacacaagaaaactttcattttgtttattttcttgtttttcttttgagacagggtttccctctgttacccaggcttaagtgcagtgacactatcatagttcactaacccctcaaattcctgggttcaagtaatcctcctgccttagccttagtaggtgtaaatacaggtgtgtaccaccatgcctggcgaattttaaaaaaacttttttatagagatgagctctcgccgtgttgcccaagctggtcctaaaacgctggcctcaagctatcctccggcctcagtcttagcctcccaaaatgctggggtttcagtagaagccaccatgccgggccacttctgtttcttttccatgtagagttctttgcaggaggaggttagaataggtgtgcatctcctaaatagttgtcgaatataactaaaaagttaaccaggactctaaatactatttacttctaaaatttgttaattgggaacatttagggtttaactgatctatatcttatgtctttaacaattttgaatgataattatatgtaaagtaagaacagtttgtgaaatagttgaaaatatccttacatgaaagtgaattttaaagcacagtttatgtaatgttaatgttttgttttgtatctgttaaaaatttgtttatatgaacaagtttacaggtttactgtggtgagcccgttgaatatagtgggttttttttgtttgttttgtttttgtttttgagatgaagtctcactcttgtcccgaggctgatgtgcaatggcgcgatcttggctcactgcaacctctgcctcctgggttcaagcgattctcctgccttagcctcccgagtagctgggattataggcacctgtcaccaaacccggctaagttttgtatttttggtagagatgggatctcagcatgttggccaggctggactcaggtgatccgtctgcctcggcctcccaagtgctgggattacaggtgtgagccaccatgccgagcctgaatatagtgtttttaagttgcaggactttaaaaataatattttgaaatttttctaagttaaattccctgttaaaatggtcatgcaggaatatacgcttgcattattcatattagggtaactgtttggtttgctagttgttagattctttgcattcctttttttttttttttttttttttttttttgagacggagtttcactctttttgacaaggctggagtgcaatggcgctatctcggctcacctcaacctccgcctcctgggttcaagcgattctcctgcctcagcctcccaagtagctggaattacaggaatacgccaccaagcccggctaattttgtatttttagtagagatggggtttctccatgttggtcaggctggtctcaaactcccagtctcaggtgatcagcccacctcggcctcccaaagtgctgggattacaggagtaatcccccacccttttaaaaaaatgagacagagttttattctgtcacccagggtggagtgcagtggtgcgatcatggttcaccgcagccttgaatctgggctcaagtgatcctcccacttcagcctcccaagtagttggaaccatagatgtgcatcaccacacctggctgatttttaaattatttgtagagatgaggtcttgcttgttgtctaggctggtcttaaacttctgggcttcagcagtcctcctgcctcagcctcccagagtgctgagatgatagacatgggccactgcccctggccgcatttttcttttcttttcctttctttttttttttttttttttgaaacggagttttgccattgtcgcccaggctggagtgcagtggcacgatctctgctcactgcaacctctgcctcccgagttcaagccattcttctgcctcagccttccagttatctgggattacagtcatgtgccaccacgcccagctaatttttgtatttttagtagaaacagggtttctctatgttggtcaggcttgtcccaaactcctgacctcagatgatccacctgcgtctgcctcccaaagtgctgggattataggcgtgagccaccatgcccggccctaactgcatttttcttagtatttgtggtttgagttaatacttgccctatgtgatgttgatttattattactggatcattaagtgaggtttaaagaagctaaatgccatttgctctatgccctctggattttaaaagtgcatgggtgtgcacgtgtgtaggtataaatgtttccatattctagtatattctgtgtcagtgatagagcagtcttagagctgtcttttccatttacttgtaggttaagaagccaaaaaaagttgtgtcatcatcccgtttaggaaaacttacattttggctattgtttcctctagtgctgctattagtggaatgattttaggtgttcaactttcagatcaatgggagacagaaatattgttctgagacatctggaagccgaatgtgttttattcctgcctgtctgaggatgtggtcttgcctttgatagggcaaagttatttgtaaacattgctttaaataaaaacatgtaaaggtgtttttgatggttaacaaaaactatgagtataatagagcctagtccctattacggactggtattgatctggtgtgggaagagtattgagcttttcagtgtcacctacctgtattcccttgaagggacccagagcccaggcaaagctctgctgaggtcgggcgtggtggttcacgcctgtaatcctagcattttaggagaccaaggcgggtggatcacctgaggtcaggagttcaagaccagcctagccaacatggtgaaaccctgtctctactaaaaatacaaaaattagctgggtgtggtggtgcatgcctgtaatcccagctatctgggaggctgaggcaagagaattgcttgaacccaggagacggaggttgcaatgagccgagatcatgccactgcactctaggtgggtccctgagtgagactccatctcaaaaaaaaaaacaaacaaaaaaaaaaaaaaaaaaaaacctctgctgaaatgctacagttaattttgccatttgtggtcagcattcttcttctaaattgctataatcttgccttcatattatgtgtctcaaatttaagcaggtatcagaatgtccacgggaacaaattgccatggctctaagcccagaatcagattcttcagatctggagtagggctggggaatttgcatttctaacacacaagtttgttgatgctgtttgtctggggtccacgcttgcctaacttctgatgtgatttatttctgccagtttctttttttgttgttgttttatttttttgagatggagtctcgctctgtcactcaggctagggtgcagtggcatgatcttggctcactgcaacccctgcctcctgggttcaagcgattctcctgcctcagcctcctgagtagctggggttataggcacactgcaccacacccagctaatttttgtatttttcgtagagacagggtttcaccatgttggccaggctggtcttgaactcctgacctcaggtgatccattggcctcggcctcccaaagtgctcggattacaggtgtgagccacccaccatgcctggcccttcctaccaatttctatcctccctgaaatgctgcacacttaggcagtcactggacaatatctgccccaaaattggtttgtataattgagaatatttaagaggttgttaaaatttgaaccactttctattcttctattaagtgtacacatctattaaagatccccttgtagctctttttatctgggccatcacatttctgcccagcagatgcagaggccctgtcctctcttccacctccccactacctctccttccctacttttggactgtaaaagctgtctttctgcagttaattgttttattctttgtaggttctactcgttgataatgttatctactgctataataattacagacggcaacaggatgatcaaatcttggatattttaaatttacattatgccttttttattttatttttttaaagtctctgcttgacagcaaataagcctaacgttccctaacaaatgatgatgtcccattaatgatttgatgacttcctgtttgtagtttttatttagagtgcttgtgggtagtttttcataacgacatttaaaaatcaggatataaataattttttaagttttttttttaggcggggcacagtggctcacacctgtaattccagcattttgggaggctgaggtgggcagatcttgtgaggtcaggagttcaacaccagcctggccaacagggcgacaccccatttctactaaaaatacaaaaattaggccgggtgcggtggctcacacctgtaatcccagcactttgggaggccgaggcaggcagatcacaaggtcaggagatcgagaccatcctggctaacacggtgaaaccccatctctactaaaaatgcaaaaaattagccgggcatggtggcaggcgcctatagtcccagctactcggaaggctgaggcaggagaatggcttgaacccaggaggtggagcttgcagtgagccgagatggcgctgctgcactccaacctgggcgagagtgcgagactctgtctcaaaaaaataaacaaataaaaaataaaaaaattaaccaggcatggtggcgcatacctgtagtcccagctacttgggaggctgggacagtagaatcgcttgaactcgggaggtggaggttgcagtgagctgagatcacccactgaactccagcctgggcaacagagcaagactctgtctccaaaaaaaaaaaatgtatttttctttgaagcttttctacttttaaatgtaatgtatagtattataacaagtgaacaaaatgatacaaagaagtatggcgggaaaggtgtggtagagatgggaaaacatatttcctccagcctcttaggttcattggaggagcttgggaattcaactgacacacgacagatttacaggagaaaagttttatttcaagtacacatgagagcttcatagaaaagaagtgaagacctaaagaaacagactggagagttcatatgccattttaataaaggataatgtattagtctgttctcatgctgctaataaatacatacccaagactgggtaatttataaagaaaaagaggtttaatcgactcacaattgcacatggctggggaggccttacaatcatggcagaaggtaaaggaggagcaaaggcacatattacatggtgtcaggcaagagagtgtgtgcaggggaactgccctttataaaaccatcagatctcgagagacttattcaccatcacaagaacggcatgggaaaaacctgcccccgtgattcaattacctcccaccgggtccctcccatgacacatggggattatgggagctacaactcaagatgagatttgggtggggacacagccaagacatatcagataataaattgtggagaggcagtaagattgaagaaaagaggtttgagcttcgaggggtggtaaattgtgggaaggtaattatttggggcaaactaatggcacataaggattgttttagtaaggcttgttatgcatacccaaaacaagtgccatctccagtaatttaagagtctatggtgatcaagagtagttctcttcctgctagaagaggggtgggagagaacaccttcacaaagggaaatttatattctgccttcatgcagaaagggggcgagcagagagttcctacgtatactgtttcttcattatcttcctctcaaaagaatacttaggctaaagtggcatgatttggggtgacattctgatcctcttcagtgacaatccttgatatttttccttctttctctccaggtaaacagtgttaacatcctggtatgcttcccccaattccattatactaactctgtattgtgggttaaagattttttactttgatcagcagtatttgaaacatacctgttatactagatgtactctgactgtaaaatagtggtcagtgttacttctttaatgatgctgtgggattaaaggattttattataaatgctgggaagagcctggatttgaggaaggtaagcagtgcagttaggtggatgtagactagaagaggtcatttgttctcatttcattgttgcccctatgacatgcccgtttctttcttttttttctttttttttttgagacggcgtcttgctctgtcgcccaggctggagtgcagtggcgcaatctcacctcactgcaagctctgccccccgggttcatgccattcttctgcgtcagcctcccgagtagctggaactacaggcgcctgccaccatgcccagctaattttttgtattttcagtagacacggggtttcaccatgttggccagggtggtctcaatctcctcacctcatgatctgcccgcctcggcctcccaaagtgctgggattacaggcgtaagccactgcacccagcctacgtgcccatttcttaaagtagaaaatttagtagttgatgatgtcagggaagaaaagctttttctctgccttacgttaagtagttgggggcaaattaaattaataaaagacagattagtgagagaaaaggctgtaagaatttggactttatataccatcataatagaggaagtaaagggagatgaagggcacttaagggaaaacagatgacttgtaggaaagataaatgaacccttaagagaatagatgagaaatatgaaggttttgtgacaatgtctgtttaggtggttacttctcttcttgttatgagagtcagtcttctggttgctggaaactgctaggagatttataacaattgggctctttcgagaggctcttcttttaagcagataagggagttcacaaaaaagcctgttctcaaatgatttcagcacacacacacacacacttacgacacagttaagtactgtgccagtaagatgtgagttgtgcatttcttttttttctctgagtagactgtttgaggttatttatatcaggacttgttatgcaggtaactgaaaactcaacataatctaggttatgtagttaaaagtatggagagaaggtaggctttatttagagttgcttgatcctgtagatctcttctaccttttgtaattttaatttcaaccaaggatggttccctttttggccctaggaccagttagcagttggggcaccattccaagcaagagtcctgcagtttgtagtgatgggaccatttaaacagtgattgtgaccagggacatagaatgggatgattggcccgaggtaaccatggttgggtatggagtcagcttccctgtaggaagagatagacaaagtctgagcactcctgggaagggggaggaagggaataactgttgtgtaaatcatcagcagtgtctactaagataccatctgtaaccataggcttctatgttttataatataaggctgtcttttaaataaatcagattccctgttaaagatctgttctagattccctagggggttgacctcatatagtatcttctttttctttggttacaaacttttaaacttgtctgaggttataaggtgaattcaactgtccactgtcaatgtagatatttttaatggatttagggatttaaattacatgattcagaaccactttgaggaagtctagggaatatcagttgtttctgtataatttctgaaagcttcactgttttctaggtgtgcacttaattcatgtgatgaagggaacagtatttacatgagtggtttggttaatttttcccctcctaagcttagctttgtgtatcgtgcgtgcttccagtgtttttgtggctgctttacataagtcttttagaagtattttctatttttgaagtaaatgtggatcaaaaccaccccaagacaggattgaaaaaaagacagtttttcgcaagaaagtaaataattttatttagcttgggactttaaatgatatgtcttaaatgtaaacatttctatactgcattttggccatcttttgatactagttttcagatgcatattgttatttcatttattattggaaaagtagtaactttaaacaaatttttattgaaaatgctgacagaggccgagtgtagtagctcacacctgtaatgtcagcactttgggaggccgaggcgggcggatcacgagctcaggagatcaagaccatcctggctaacacggtgaaaccccgtctgtactaaaaatacaaaaaaattagccgggcatggtggcaggtccctgtagtcccagctactcaggaggctgaggcaggagcatggcatgaatctgggaggcggagcttgcagtgagccaagatcgcgctactgcactccagcctgggcaacagagcaagactccatctcaaaaaaaaaaaaaaaaagaaagaaaatgctgaccaaaaaaaatgaaatagttttaaagaagccacagttgtgtgatcctgatacaactatatcattattgtatgagtatatatgagttataaaaatagtatatgtaaatgcttcataatttttattattagaaatgaaaaagtataacaaggggggtattcatattctctccacttagaattaaccctcaacatgttgacatctttgtttatagtaatccttttttgttttttttgttttttattatactttaagttctagggtacatgtgtacaatgtgcaggtttgttacatatgtatacatgtgacatgttggtgtgttgcacccattaactcgtcatttacattaggtatatctcctgatgctatccctcccccctccctccacccctcaacaggtgtgtgatgttccccttcctgtgtccaagtgtcctcattgttcaattcccacctatgactgagaacatgcggtgtttggttttttgtccttgcgatagtttgctgagaatgatagtttccagcttcatccatttccctacaaaggacatgaactcatcattttttatggctgcatagtattccatggtgtatatgtgccacattttcttaatctagtctgtcattgttggacatttgggttgattccaagtctttgatgttgtgaatagtgccgcaataaacacacgtgtgcgtgagcctttatagcagcatgatttataatcctttgggtatatacccagtaatgggatggctgggtccaatggtatttctacttctagatccctgaggaatcgccacagtcttccacaatggttgaactagtttacagtcccaccaacagtgtaaaagtgttcctatttctccacatcgtctccagcacctgtcgtttcctgactttttaatgatcgccattctaactggtgtgagatggtatctcattgtggttttgatttgcatttctctgatggccagtgatgatgagctatagaaatcctttttagaaacaacagagccttgttgtaaaacaggtaaatgtacgtgaggacttcaaaaagtttgtggaaaaatggaattaaaagataaaatttaaaaacacattttaaatttatttcccaacataagctcctcaagttcaagacacttttataaatgatgatctcagctgtttagttcatccgtaaagaactgagggtactagaaattttaccatgtcaatgcagtctctttacattactaactaaagaaaaataggtgctctttaaagatcttttaagattaggaacaaaaagaagtcagaagaagccaaatcaaggtggatgcttaacgactttccatagaaacttacaaaattggccttgtttgatgagaagagcgtgcaggaacgttgtcatggtggaaaaggactttgatgatgctttccctggcatttttctgcaaaaacttgggataactttctcaaaacactctaataataagcagagcttatgttctttatccccccagaacatcagcaagcaaaatgcctgaacatcccaaaaaactgttgccatgacctttgcccttgactggtccacttttgcttcgactggaccacttccatttttggtagccattgctttgattgtgctttgtcttcaggatggcattggtaaagccatgttttggctcctgttacagttctttgaagaaatgcttcaggatcttgatcccttgtttaaatttctatggaaagctctgctcctgtctgcagttaatctgggtgcaacagttttgtcacccatcaagtgaaaagtttgttcagctttaatttttcagtcagaattgtgtaaactggaccaattgttgagatgcctgtagtgttggctattgtttctgctgttagtcattagttctcttcaattagggaatgaacaaaattaatttttcctgaaaaattgatgtggatggtctgccgctgtgggcttcatcttcgacatggtctcatcccttgttagaacaagttatccgtttgtaaactgctgatttcctaggagcattgaccccataaaattttcataaagcatcagttatttcattattcttctatgcagacttcactataaatttgctgtttggtcttacttcaattttagcagaactcatactgctctgacatctaaactgatgtcttagccttcatagtgtctctgactagatcctattcagacgtgttatagcaaattagtaaagtttattttggtgccaaaaacttttgaatccacgcatagttttttcacaacacattttccatgaactttttgaagacccttcatatattataagaagaaagttaaaaatatcccctgcatctactactcagaaataaccactgttaacattaagtctgttctcaactctaggcattattgagggttttgaggacaggtcttgaaaatttctatggctaccttttactgggtggagactagcatgtatagttgaccgcataggttaatccctccactcaaaaagccacaattttaaagtgtagtattcactagcatttagtatattcacagtgttgtgaaatgaccaccaccatctagtttgaaaatatttcatcacaaccaaaagaaaacctcatatctattagcggtctctcctgtttccccagacaccggcaaccactaatgtactttttgtctctgtggacttgtcagttctggacattttatataaatggaatcatgtgaccttttatgattgacctctttcacttagtataatgttttagaggctcatccacattgtagcatgtgtcagtacttcatttccttgtgtattggtccattcttgtactgctataaagaaatagctgagactgagtaatttataaagaaaagaggtttaattggctcatggttctgcaggccgtacaggaagcatgatgatggcacctgctcagcttctggggaggcctcaggaaatttaaaatcatggcagaaggggaagtgcggcgtcttacatggtggagcaggagcaagagagagaagggggaggtgctccacacttttaaacaactagatctcaggacaagtcagtcactataatgagaacagcacccaggggaaaccgccctcacgatccagtcacctctcaccaggctccacctccagcactggggattccagttccaattcaacatgatacttgggtgggggcacatatccagaccatatctcctcgtatagctgaatagtattcccttatatggacataccacatttattattaatttattgattgattgacaggatcctgctctgttgtccaggctggagtgcagtggtttgagcatagctcactgcaggccttgaattcctgggctccagtgatcctcccacctcagcctcctgcgtacctgagattataggtgtgtgccaccacacctggctaattttttttattttttagcagagacagggtttttgctatgtttcccaggctggctttgaactcctgggctcaagcaatcctcctgccttggcttcccaaagttgtaggattacaagtgtgagtttagagaggtataatttcttactcaacttcaagtattttatttctcttatcatttgttgtttggtttgttaattatttggaagtatatttttaaatttccaagcttagtgtgtgtcagtttcataaaagttccccatgtatttaaaaattggatgtgtactctaattttgggattgctttttcattgtctatatatgcttgctaatttttgatctgctgggttactgagaaggatgtgggtttctccatctagttctatttttggttaatatgttaggcacagagctgttgtttttttgtggtgaattgaatcttcatcattctttagggactctgtccttaataatgctttttttgccttacattttgtttcattgtaagagagctatgtcagagtactttttaaaacactttttaatatggtatatatttttttcttttttaatgaggttttttaaccgtaagtttaagcaaaataaagcttaataactggattttatttagttttaaatttaatttgatttttttttttttgagactaagtctcactctgtcgcccaggctggggtgcagtggtgcgatctcagctcactgcagcctccgcctcccgggtttaagtgattctcctgccttagcctccctaggagctgggattacaggcgtgcgccaccacgcctggctaatttttgtatttttagtagaggcgggctttcaccatgttggccagtctggtctcgaactcctgacctcaggtgatccacctgcctcagcctcccaaagtgctgggattacaggcatgagccaacactcctggctaatttaattcgatttttttagtagcagttttagtctattatgtttgttgtagttactagtatctttggatttatttctacctaattatttggtgattcctcttcttcctggttccacttacacattaaaaaaaaaaacaaaaaaaacttagaatagagatggtgtctcactatgttgttcaggctgctctcaaactccagggctcaagttatcctcctgccttggcctcccaaagtgctgggattacaggtatgagccaccatacctggtcccccttgcccattctgttttacttttgtattgcttgggtttctaaaattccattttgtcctctccctttgctcttccccaatcctatctcatcacacacactggtttggaagatagccacttttttttttccaatgtgtttacttatcttatcagagtcaaaagcctatcagtatcttctcagatatcccaaaaaatactaggaccttaagacacctaaaatcaggttacatttcttcataattgtctagtattctagttctatcagttttacctctcagatctccattctgtaagtcaatgttaagtttagatttgtccatatgcatacgagtttctttggtattcaatacttcctgtatatttttaagaagttcctttgttggaggtctgttaggttttatttgtttgaaaatgtctgtatttcacccttgttcttgaaggatggtttttctaggtatacagttcttttttttttttctttgatacagttttgctcttgttgcccaggctggagtgcaatggtgcgatcttgactcactgcagcctccacctcccaggttcaagtgattctcctgcttcagcctctcgagtagctgggattacaggtgcccaccatcacacctggctaatttttggtatttttagtagacggggtttcaccatgctggccaggctggtcttgaactcctgacctcaggtgatctacctaccttggcctcccaaagtgctagggttacaggcgtgagccaccgtgcctgacaaaggcctaactttccttcctcattcttttcatcttgtttcttggtttcatcatcccattttttagtttcttttcagtctccttttgtgtagcctgaagcaataactgtgtttctgatgcctaggtaagtatactgtaggtaggctgatactgttcagctagtacatagtagaagtcagatgtcacatttttagaatactccagttctagataagaataccttgttgggtgatatattttattatcctggattgtttggcggatgtaatggattgctgaagacgcccagtttcctgtgtggcccttgagtatttattttagtaagttagaggctagttgttcacttttcccttgtttaactggggactcctcagcagccctttcaaaacagtataacctcatctgagaaaggaaaatgtaaggatattcattaagttttcttctctccagatttgggattatttttaggaattctcaagagttttgttgacttaccaactaggtttcttgaagatggtgagtgaggataggaacttggcctggtttggctcacctctcagattcattggaagaggcaagttcattagcacagtttcagtccaccattacagcatttttttcctgaattattataagtcttagtcaatatttccagataatcatcattatctgtttaaattactgcacagtattctattttactgatgtaccattgtgcaaatactatgatgttttattatttttaagttttgctataacagataagtctgcagagattttattcagctctgtattgttttgcttctgttgcattgtttcctcagattgaatttctaggagtagaattgctatgtcaaagagaataacaagtatctctgagccttgccgcatactgcttttttcatttttaaaggttataccaagttagagtctcactagaactgaatgagtgtactaattttactgtagctagtttctttttttttaaaaaaaaaaaaagctgtagaataatctcaaggttgcttaaatatttctgtcttttattcttacagcatttcctgtggattagttcactacttattttcttatctgtgagttgtaagtgcttacacatgcccacttgatgaccttgatgttttcttacacatggaagcaagtgctttttgtaaaagaatatattaacctttatctttttacattttgtgaagctttttttttaatgtttcatcttttaaaaattaggtttattcagaattttaaattttaatattatattgaatttcttttggttggtttaaattgagaaagttattttatgtatattctctttttttgctagctttctgtaatttgattttaattccttattccttgcatagtttgcttctggtatgttaaagtgtgctctctctaagtgggtagtaattaggaacaatttatctcaacctcatttattgaatgttttaaatcaagagaacggactctgttatattaagcttctatatataattgtctgtttcactgtaatgcctagtaaggatacacttcattctttttttagatgttctttcacaatttcatgtaaattttagttgttttgtttcaaaaaacaattcctattgaacaatctctaggaatagatagcttaataataatattagatctagttttctcttttcatagtttacctcttctttcttttctttcttttttttttttttttgagacggagtctcgctgtgtcgcccaggctggagtgcagtggtgcgatctctgctcacagcaagctccgcctcccaggttcgcgccattctcctgcctcagcctcccaactagctgggactacaggtgccccccaccactcctggctaatttttttttttttttttttttttttttttttgtatttttagtagagacagggtttcattgtgttagccaggatggtctcaatctcctgacctcgtgatccgcccacctcggcctcccaaagtggattacaggcgtgagccaccgcgcccagcctctgtctctcttttctttttctttttcttttcttttcttttcttttcttttcttttcttttcttttcttttcttttctttcctttcctttcctttcctttcctttcctttcctttccttttcttttctttcttttcttttcttctctcttctcttctcttctcttctcttctctgtctttttttgacgagtctcagtatgtcacctaggctggagtacagttgcacaatgttggctcattgcaacctctgcctcccttgttcaagtgattgtcctgcctcagcctgccaaatagctgggactacaggtgcgcactgctacgcccggctaattttgtatttttagtagagatggggtttcaccatgttggccaagccggtctcaaactcctgacctcaagagatccacctgcctcggcctcccaaagtgctgggattacaagtatgagccacgatgccagtccaattcttgtgtagttttttaatcagctgaatttaacattcaaattcttcttttaaatcttccaataggcagttatctttataaagatcctatataatcaagactttgtttctgaatattttatgtatgtttttgctactgtaaatgagatctatttctcattgtggtttcttgctgttattactggtaagaatttagtgaaacaaagtacttaagagtatgtctttaaattgtgagattttgatgaacttttaagaaataaaattctttagtttcttagagctttttgagatttctaaggtagatccttggtttgggcaacatataactattacaagttttgcacattgaacgttatttggtaatttttagagaggacattttaaatgtttaggaaaaatataaataaaatgtagaatactattgggggcatatacatcatcagcactgtaactgtttcatatgaatcatttttgtacatatagaactctaaagtcctaatgaacagaattttacatttctataaatagaaagtccttaatagttgtgactgaataacttatggatagcaaattatttaactgaaaacagtaaaatttaagtgggaggaaatatttgctttataatttctgtctttacccattatttataggattttgtcactttgttctgtttgcaggtggaaaaccatgaattccttgtaaaaccttcatttgatcctaatctcagtgaattaagagaaataatgaatgacttggaaaagaagatgcagtcaacattaataagtgcagccagagatcttggtaagaatgggtcattggaggttggaataattcttttgtctatacactgtatagacaaaatattgatgccagaattattttataagttccctgtccccaagatgatgacttcacatctctgtcaaacagaaatcgcccaacaggcccttgtatgatgtcatttaaacaagccctattttaaatgtcacctccactggtaacaggatactcctaggaggatcaccaagcccaattcttctaggagtagtgcattgattaggctttggggtttccaagcagttcattaatgtcacttttggaaaaagtctgtctttcataccagcttattaattccctatgggttcacacggttttttttcctggattttcatcaaacatgtgtaaggtactcagtacaaagaagtttagaaatccagaacaaagcagtgtatttaagtagtagtaaacttccagataatctgatgcccatatctacatatataaaaaatttgcaaatagttctgtagagagtccaaacatggagtagatccctaattaagagcctttgcattaaagtccaccttcctcatttcatagctaaggatattgaggctcagagagtttatgtgtctggagttaaagttattttgtgtttccttaatttttgacttactagaaagttaaagtacctacagatttctgtgtttcactatatgttaacttgcttggctggaagtttttctgctgataattggttttatgaaggaagaatcctgttaagaatgcatcattggactgggtgtggtggctcacgcctgtagtgatcctagcagtttgagagaccgaggtgggcagattgcttgagtccaggagtttgacactaacctgggcaacatgatgaaaccctgtctctacaacaaatacaaaaattggccatacatggtggcacgcacctgtggtcccagctactcaggaggctgaggtgagaggatcacttgagccagggaggttgaggctataatgagccataattgcactactgcactccagcctgggtgacagggtgagatcctgtctcaaaataagaaaagagaatgcatcattggccaggcacagtgactcatgcctataatcccaatactttaggaggatcacttcagcccaggagttcaagactagcctgtgccacatagaccacatttctaccaaaaatcaaaaggaaaaaacttgctgggtgtggtgatgcacacctgtggtcccagctactcgggaggctgaggtgagaggattgctttagcttaggtggttgaggctgcagtgagccatgatagcaccactgcattccatccagcctgagggacggagtgagagcgacaccttgtctttaaaaaaaaaaacagaggaatgcatcatagtatatattaaattattgcctatttttttatctattttattgagtgctaataagaaaattaatggcaaaaacttgttttttacagtataaattaagtttaatttcattttaaaattaagtaaatttgttttattaaaaagtatgttgaaagcaacataaatagcactcaaattgagacagaaactgtaactgtagtataagaagcattaggctgggaattgggaaacacgagttctagttgcagcttggaaactttttctgaagctctttacaaattacttaatttctctggttttcaccacattgttctatagcattaacatgttggattcattgctttaattcttagacctacgtgtcatcagaaatgccattacactttgaggatttgagccttattttaaataaagttgtgatcctcatggcagcctaggtttacatgtgttaaataaacagtattctgtaaataccattgtctttcatgtttagtgatgttgctgttgttaacactgcagtgaaatgcatatataagcaaactacattacatactcatgaacatggtcctttgttttgaaactttgatcactgattgttcgcagtctttcattgtggaactactctttcactttgaatgttttgagaggttcctttgttcagatcagtccgatttcgtttctgggtgggtctctactttcccttttctcactggtcaagcgaggtctgtctaattgtttgctactactaacatttgatggccacgcttcagcaagtacatttgtagattctctctctctgtctctcttaatttgtggtctagagatcatattggttaatgaaattatgaagagggaatgtatttataaaaactcaaattcttgatgcagaaggtctagctgattgtgaacccaaaatatccgagacaggtcacaaccaatttagaaactttattttgccaaggttaaggatgcatccatgacatagtctcacaaggttctaatgacacatgcgcaaggtggttagggtacagcttggttttatacattttagggagacatgagacatcagtcaacatgtgtaagatgtacattgattctatccagaaaggcaggacaacttgaagcaaggggctttcaggtaataagtagataagagacaaaaggttgcatacttttgagtccttgatcagcctttcactgaataaacaagcttagtcttgttagtgaatctgcgtttttacataaacagtaggtcagaggaagcaatcagaaatgcatttgtgtcaggtgagccgagggatgactttctgtccctcacctgtgaagataagctatcagtttccattgctagggtgaaattcaacagaattgtttgagagtgaacatctggaggcccacaaggactttccttgtggaggggaagtatgtagtgagggaagtatgtagtttttaaatctttgtcgctatcttatttagaaataagatggaaggcaggtttgtctgacatagttcccagcttgacttttccctcggcttagtgattttgcggttccgagatttattttcctttcacatatcagtcagatcatttggtttgtgaagtttcctatgcttaacagaaaatatgtgcactagttttcctagagtttcattgtcagagtctcaagtttttgtttggaaattgtatttggtcacattaattatactctatgttagttccaaagaaatacctttggttaagaaaagaattctcatgcataactcctcgagggtggggttacaccttaatccatcctcaggtgctcatggtaattggggcaaatatgttgcccagtgctggtgctctgcagccttggatgggtttacccagaaagcagctttcaagtcagaaactaacattcataagggagttaaggattttataaatagatatccataattcatgtagttttcaagtaagtagtatttgaatcttttctggttagataataattgtgagtatgttgtcatataataacagtatgtttttcactatttaaataattttagaattacattgaaaaatggtagtaggtatttatggaatactttttcttttcttcttgattatcaaggcttggaccctggcaaacagattaaactggattccagtgcacagtttggatattactttcgtgtaacctgtaaggaagaaaaagtccttcgtaacaataaaaactttagtactgtagatatccagaagaatggtgttaaatttaccaacaggtttgcaagtcgttattatatttttaaccctttattaattccctaaatgctctaacatgatgtgaatgttctatgataagttttactaatgtagtcatcaggtaagagtcaagctttcttccatagagcagtcagctgtcgcaacaccatttgttaaatagtccgtctgttctccattgactgaagtggtactttgggtctattttaaagactctacttttacctcgtctcaccattcttttgtctacacaaaatatattttatcgcttattctgtgttaccatatctattagagctagttccccctcatatctctgctttagttattttcacatgtttcttttatcttttttttttttggagatggagtctcgctctgttgcccaggctggagtgcagtggcatgatctcggctcactgcaagctccgccttccgggttcacgccattctcctgcctcagcctcccgagtagctgggactacaggcgcccgccactgcgcccagctaattttttgtatttttagtagagacggggtttcaccgtggtctcgatctcctgacctcgtgatccgcctgcctctgcctcccaaagtactgggattacaggtgtgagccaccgcgcccagccttatcttttttttttttccccctgagacagagtcttgctgtgtcgcccaggctggagtgcagtgacgcgcagtcttgactcactgcagcctccacctcccggattcaagcgattctcatgcttcagcttcctgagtagctaggattataggcatgcaccaccacgcctagttcatttttgtatttttagtagagatgggttttcaccatgttggacaggctggtctcggactcctggcctcaagtgatccacctgcctcagcttcccaaagtgctgagattacaggtgtgagccaccgtgcctgacccacatgtttattttttctaagaaaactttactatcatttatcaagttaagaaaattattctgatatttcaattgggtgtttaaattagttgagggaaatatgaggccattcactagatgataggttttttttgttttaatcatgtttcatgttgaaacaaaaaagttttttcctgccagttttctggctaatctcaggaagtccctgaaacaaattattgataagtaaaaaaaattatttaaaaaattttaaattatatttaaaatcttctgtgacttatggtggggggaggctaaagcctttctccttctgtactgttctggaaactatggcctgttctactccctcccctcctgaattttcccagaactttacaggtagcttttatatatatgatcccctgtcgtctgtttaacaagtactttgagtgtctattatatgcagacattctaggtgttcagacaccctagtaattagtttgttcctcataattctcagtaaagaagacatgtatatttctcattttataggtgaagaagctaagactttacttttcctcagttagacagctagtgctggtgggtgcctaaacttagatcttccattgccaaatctaggtgtgttgtttttccagcacactagaatcctcctggttcaagaaatgtatatattttagcttggataagatacaacttttggagtgttctaatcatcttcaagtttttcgtggattagttataacatatgaaaaaagatagggctgaatgggccacatgatgccaaaagtgaaaaagtcactcactagattatgacctgcagaatctggtccttgcctgcctctgcttttatattttgcagcttgtcccttcacacagtggtctcacttttataatgtctttccctcatgcatttctttaattctttttatttgcctgttccatagtagtctgtttgtgctgctacttgcccctgtactgttcttgagctatacatatacatgtctgctgtgccattgagtgattccatcaaggccacaattatcatcttgatgaactgattttctcccactgctgataattacttctctctcctttctttctcctttacatcacctctttttgttcttaatttcattccctccttgatgccagtgagtatttttttcttattttattctcatcttccttgagtattgtttatttcaacctctttttttttttttttttttggagaagggtttggctttgtcgctcaggctggagtgcagtggcacaattttggcccactgcaacctccacctcctgggctcaagccatcccacctcagccacccaagtagctgggactacaggtgttgcccactgctttgtatttttaatagacacaggatttccccatgttgctcaggctggtctcgaactcctgggctcaagcagtccacctgccttgccctcccaaagttctgggattacaggattacagatgctgtgcccggcccaacctctaattttaattttctcttcaaattgttcaataagatttagtttcaagacattttcctggccgggcatggtggcttacgcctataatttcaacactttgggaggccgaggcaggtggatcacttgaggtcaagagttcaagaccagcctggccagcgtggtgaaaccccatctctactaaaaaatacaaaaattagccgggtgtggtggtacatgcctgtaatcgtagctattgtggaggccgaggcatgagaatcgcttgagcccgggaagcagaggttgcagtgagttgagatgacaccactgaaatccagcccgggcaacagagtcagactacgtctcaaaaaaaacaaaacaagctgggcgccgtggctcacgcctgtaatcccagcactttgggaggccgaggccggtggatcacgaggtcaggagatcgagaccatcctggctaacacggtggtgaaaccctacctctagtaaaaatataaaacattagccgggcgtagtggttggtgcctgtagtcccagctactcaggaggctgaggcaggagaatggtgtgaagccgggaggcagaggttgcagtgagcctagatcgcgccactgcactttagcctgggtgacagaacaagactccgtctcaaaaaaaaaaccatttttcttattttgaaaacttttggtattgaaagatatttatactacagtaatgagaaatactgtgtgtgtgtatatatgtttgtgtttttttttttgtttttttctttctctctctctcttttttttttttttgacagagttttgctcctgttgtccaggctggagtgcagtggtgctatctcgactcaccacaacctctgcctcccgggttcaagtgattctcctccctcagcctcccgaatagctgggattacaggaatgtgccaccacacctaactttgtatttttagtagagacgggttttccccatgttggtcaggctggtcttgaactcctgacctcaggtgatccacctgcctcggcctcccaaagtgctgggattacaggcaccctgcctgtgtttgtgttttaaaaggggtaatagcttcagtcttttttttctttctctgagacggagttttagttttgttgcccaggctggaatgcaatggtgtgttcttggctcaccacaacctccatttcctgggttcaagcgattctcctgcctcagcctcctgagaagctgggattacaagcacgcgccaccatgctgggctaatttttgtatttttagtagagacggggtttctccatgttggtcaggctggtctcgaactcctgacctcaggcaatccaccgacctcaggtgatccacccgcctcagcctcccaaagttctggggttacaggcgtgagccaccacgcccggctgtcttcaatcttaaataaggattccatttaaatattttgtaaaaggacacagatcacagttttactcaggggaatataattgttatagcaggaattgtgccattgcgctattccaaacagtgtaaaagaacattaataaattgaattctaactacatttgtccctaaggagttgttcgttttccacttgtatttccattttaattatcattatttggatgtttcataggatactttggatatgtttcacgtagtacacattgcttctagtacacattttaatatttttaataaaactgttatttcgatttgcagcaaattgacttctttaaatgaagagtataccaaaaataaaacagaatatgaagaagcccaggatgccattgttaaagaaattgtcaatatttcttcaggtaaacttaatagaactaataatgttctgaatgtcacctggcttttggtaacagaagaaaaatcatgatatttgaagtgtgttttgttattttcgcaagccattacattctgactatttaatatgttaggtttcctatataaaataaggcatggtatgttacagtaggacacataactggaagttactcttgcacatagaaacaaaaaatggcagaaaagcacaaaacttactatagttgtaacagggaaaggaaacactagggcctacaacgtactaatgtcttgggtcatctatgggctcatgaggctctaggttatggaagtaaataccactgaaaagcaaatattaattacacatgaggcaagcctttttgagttctgtatgtcattttgtagattttgagttcattctagtggcaccatttgagatcattttcatgtaattaaaggaacacagcaacctggcactgtgttattgcccttagaatggaatgaatatatgtttagcacaaggtaggaagtgatgcgttaagttggaaggctttgccgatcatggtgtgtatgttgactaacctttattgtgcctttaaaaaatatactcaagaactaccttaaccaagtaattaaagtcaagattaccagttgtgggacaaatgacatgtacttcctggtgtgatatagaaggaaggacacagtatcacctatatagtattcttgaccagaatatttaacctgattttaaacaagaagtaaaaattcaaataaatttagattgtggtgcattcaaggcctgaactttaataaatgtccatgtcacggcagcaaaaaagaaatcaacaggtcttaaagagacagggcaaccaaacgcagtaggcagtagttgattagatcccaatttagaggttggagttggggaatagctatagaggacactattggggcgaattgagaaagtttaatatgagacaatatggtgttagtgtcagatttcttgtgtgaaatggtagtgttatgattaggagaatgtccttgttctcaggatatgcatgctaaattatttaaggacaaatatttttttaaaaggttatgtgcatgagtaattctataaattgtgttgctattatgaattgtcatggtaaatcaaaaggaaacataaaactcaaaaggttttattttaatacactttatgtattgaaatgaatggaattgatttgtaaagattacatttttgcttgttggtgtcagataactgtgacgtaataatcttttgctgaattatgtttcttaggctagatttcattttaaagaaccctgtaaataccatttatttgaactgtggatcttccttaaaaaataatatttattaagcacctagcagggtaaagtttttagattttaacatttaaattgaaggttttatattagaagtcaacctgaatttaaatgaaacttcttcttggtctgatattacatattatgagctatttttatttaaaaatgtaatggcggccagacatggtgattcacacctgtaatcccagcactttgggaggctgagctgggaggattgcttaagcccagaagtttgagaccagcctagccaacatagggggaccccaactctacaaaaaaatccaaaaaatattagccggctgtggtggtacatgcctgtagtcccagctactcaggaggctgaggcaggagaatcacttgaacccaggaggtcgagggtgtggtgagccataattatgctactgtacttcagcctgggcgacagagcaagactcccatctcaaaaagtgtaatggatcactttaataattttctatcatacaattaagtcataaaaggtcatgctattaagagccagttatgtgacatgccaagtatagactcttaattaagatgctttggtttgctttttatttatttatttatttttcagatggggtcttaccatgttgcccaggctttagtgcagtgatgcgatcatgactcactgcagcctcaacctcctaggttcaagggattctccccacttagcctcccaagtagcttgggactactacatgtagtagtgccaccacacctggttaatttttttttaattatcttttgtggagatgaagtctcactctgttgcccaggccagactcaagcagtcttcctgccttggcctccgaaagtgttgggattacaggcgtgagccaccctgcccagcctagttttcttttttttactataaacttattcttgtcagtatgctagcaattttacaagttttaaagtagttatagcaagtacttcactcatgtttaattcttaaaggcttctattgctatataatagggtagtctgaattcttcaaaagtgtactgaggccaggtgcagtagctcacacctataatcccagcattttgggaggccgaggcgggtggatcacctgaggtcaggagttcgaaactggcctaaccaacatgttgaaaccctgtctttactaaaagtacaaaaattagctgggtatggtggcaggtgcctgtaatcccagctactcaggaggctgaggcaggagaatcgcttgaacccaggaggcggaggttgcagtgagccaagatcacaccattgcactccagcctgggcgacagagcaagactctgtctccaaaaaaaaaaaaaaaaaaaaaaaaaaaaagtatactgaaacagaggaagataattaggtctgcttggccattgttaagttgatttttattttcaaaacatttgatcactgttgtggggaacaagggaataaaaaataagttaaatttccagcccctagattaaactaataatttttggttttcctagaattaaatgcttttatcttgaatgttctgtgaagcttttgacatgattgatagctgtatgatagtctgaatgacatgtgggtcatgcaccagcccctccaacctgttaacatttagaatctattcagaaaaatttaagcattgttaatttcctttgttttttgtctagcatgtgtcagatttttttaaatgtatttattaatagcttttaatgttaatactctagaacagtagaatcttgaaaatgttttaagtgacaattagagatttaaatttatgctgacatcctctgcatgtgatactgatgaggaaagaaagccaaactgtcttacggtcagttcgtacaatataccaggccttgatggtcacatttcaacttgctacctttttgcttacatttttcttatggtgattttgaggtgtcattctggtttctcagatacttaaaatataggaaaaggtgtgtcttaaaattgagagaatgtcttggataagcagctgtgtagttttatattttgctgataagggaaggtactctatttttgttttttgtgtgtttttgtttgtttgtttttgagacagaattgcccaggctggagtgctgtggcgcaatctcagcttactgcaacttccaccttctgggttcatgcaattctggtgcctcagcctcccaagtatctgggtttacagacatgcaccaccatacctggctaatttttgtatttttggtagagatggggtttcgccgtgttaccaggctggtcttgaattcctggccccatgtgatcccccggcctcatgcgatctgcccgcctcagcctccctaagtgctgggattataggcgtgagccacccaacccagccagtactctgtttttgatagctattcacaatgggaaaggatgtagcaacacattttaaccctatgttgagttttaggtgggttcctttgaaattttgttaaggctaacttttgttaatttttttaaaaaagtgtaaattaggaaatgggttttgaattcccaaatggggggattaaatgtatttttacggcttatatctgtttattattcagtattcctgtgtacattttctgtttttatttttatacaggctatgtagaaccaatgcagacactcaatgatgtgttagctcagctagatgctgttgtcagctttgctcacgtgtcaaatggagcacctgttccatatgtacgaccagccattttggagaaaggacaaggaagaattatattaaaagcatccaggcatgcttgtgttgaagttcaagatgaaattgcatttattcctaatgacgtatactttgaaaaagataaacagatgttccacatcattactggtaaaaaacctggtttttgggctttgtgggggtaacgttttgtttttttttttttttttttaatcttggagtagaaatatatttaaaattgatggagaaaattcccagttcttaacattagaaagggaatatattattcttaccagttagtaatctattcacatttggtttagagggaagatttagaaggtgagataaaagcttgtgagagaatagtgtattcatgtgaaacttcttccatgggttcagagcatttagaaacaaacatcccttcacactcaaagcttacctttgagccagtcctccaatagtgaggtctttgaaggtcaggccaaattggctgtgggaggacctcaggttaggataggaattattttaagacatggcactatattcatgtgaaactcgcaaaaactagccttgcatataggctcatgtatcatgtctcagctgagatgtttgagagatcttaactagattctagaaaacaaaaaaggaagtagttttggggcaaatatatttgggaaacagtttattgtatttcctttccccaaatggattttcaagttcttcatataatctaaccccaacaaataaattgcctgtttttcaaaagaaagatcatgtcttcaggtttttgtgtggggtttaaatgattcgaaagatttgaccatactgatacattcactagtaaccttagttactaatgagtaatggttttgagttaatcagttaggcctgaactacttttctggaagttagtaaattatctcacaggcagccctgtgagccatgggaaaatgtgtatatggtctttctaggccacagtcaaattacaggtatatttgtcatggcttctcttgatgaaaggcccagtatcggtttgtctgaagatatataatagcattgcttttgggggtaatatgggcagtaactctgtccacatctttgggcaggctgtggttctgcctttatatgctatgtcagtgtaaacctacgcgattaatcatcagtgtacagtttaggactaacaatccatttattagtagcagaaagaagtttaaaatcttgctttctgatataatttgttttgtaggccccaatatgggaggtaaatcaacatatattcgacaaactggggtgatagtactcatggcccaaattgggtgttttgtgccatgtgagtcagcagaagtgtccattgtggactgcatcttagcccgagtaggggctggtgacagtcaattgaaaggagtctccacgttcatggctgaaatgttggaaactgcttctatcctcaggtaagtgcatctcctagtcccttgaagatagaaatgtatgtctctgtcctgtgagaaggaaaagtatatttgcagattctcatgtaaaaacatctgagaatgtttgtcttagtttaatagttgttttcctgtggactttatatactttgtattgtcttaaaagagtgattgatggtagctacggaaaactttgatttttaaaattgtctctttaagtagacaatttataagctactggtacgagttcaccttataaatctccactaccatgtttttgcttggactgttcacacttcctggaatggtccttcttgccgtttatccaacttctttctaatttttaagtccctaatgatgggaattctatttctgtagtgatttttctggtcatacgaccgtaaggtcatgggtgtttttctctgaattcctcttgagatgcctgtaacttgaaccacgtttttattctagacattactgaaatgttttgtctttatttcactttttaggagcttccttgaaggtagggactataccttctatttcttggtatctttttctttctttttttaaaagttttttagagagacagggtctcactcttttgcccagactggtctcgaactcctgggctcaggtgatcttcctgccttggcttcccagagtgctgggattacaggcatgaaccaccgtgatcctccttatttcttagtatcttctaaagaacattaaatatagtaggtgcctagtaaattatgtattgatttaacttctttgaggttctgttgtttgtgaagaattataaaagcaatacaaatgtttgtatagtaattaagcaacaggttaatattcatgacttaaaagattaaagaaataagcaaaacatgttagctggcaactcacagaaaaagaattaaattgccaatgagcacacgagcacatgaaaaattagcaaaagtttcacccctttacatatatttggttaaaattgagaaaagaatagtaatagatggtattggtaggactgtggcaggcacacaatttacatgaccaccaaaagtgtatgcaggtatccatgtcaccacaccctggtctcatcttcattcagttttatttattttttttaatctcggcctatttgattggcacgaaatgaatgatagctgccttatttggaattcctttgattactactagtgtgcttgataatgtaaaacaatattcaaaatctgtttttcctttcatccgttgtttgttcatgttcatgacctttttttttttttcctattctcctccctccctccctccctccctcccttccttccttccctccttccctccttccctccctccctcccacacaaaggtgtgtgctaccatacctggctagtttttaatttttttttttttttttttttttagaggcaaggtctcactatgttgctcaggctggtctgggctcaagtgatcctcccacctccgccttccaaagtgctgggattacagacgtgagccatcatgcctggcccttgcccatttttctattgaagttttagtgctttttattgactttgtttatatattaagataatccattatgtttgtggcatatccttcccaatgtattgtcttaattttgtttttgtatgtgtatgttaccacattttatgtgatgggaaatttcatgtaattatgtgcttcaggtctgcaaccaaagattcattaataatcatagatgaattgggaagaggaacttctacctacgatggatttgggttagcatgggctatatcagaatacattgcaacaaagattggtgctttttgcatgtttgcaacccattttcatgaacttactgccttggccaatcagataccaactgttaataatctacatgtcacagcactcaccactgaagagaccttaactatgctttatcaggtgaagaaaggtatgtactattggagtactctaaattcagaacttggtaatgggaaacttactacccttgaaatcatcagtaattgccttattctaagttagtataaattattgatgttgttatagaacccatttaccccttaattcacagtctgggggtaggaacatgtacatcatatttctgtatctcatagtaggaccactcattctaaagcattcacagaaagaattatctgtactctttttgggacagaatctcgttctgttgcccaggctggagtgcgatctcggctcactgcaacctccgcctcccgggttcaagcgattctcctgcctcagcttcccgagtagctgggattacaggcgcctgccaccacacctggctaatttttatatttttagtagagacggggtttcaccatgctggccaggctggtctcgaattcctgacctcaggcaatccacccgtctcggcctcccaaagtgctgggattacaggtgtgagccaccacgcccggccagaattatctgtactcttgaacatcaccatggaggcattttctgctacctcccatggcagtatgttttcttgttgaattaggataacaaacaatatgctttcaagttccaaagttctagctgttattgtttaacaaaatcttcattataattagcttattttgtgtttaagagtgtgttatagaaacaggttcatttaaagctgggggttccagaaatcttgaaatagtagttatcacatgcagagtgacttatctgttgttgtttcatcctttcaggaaagtttgtcattcgtgggcttgggatctagtcagatccctgtattgatgagattcacatgttataaggctttcaaaggttttaaaaatcatactataaggattgatttcactagtcaccagaataactttttcagatagcgctctgattttccacgaacacgtttttctgcatcagttggttgcacatgagtgagataatcttggttctttatcctttgttatttgtacttcattgggaatccttttgagttagtatatttgagtcattattattattgctgtagaattcaggaacttttagtagatctggcagcataaaattttgcttttaaatcattgtttgtgttttgtatgctatagaaatgggttcagaatattttttaaaaggccagatgaagtgtgaagatagaaaaacttcatccttcactgtgaatgtttaacaaacatttgcttctactttatttttgtttgcttcctttagttgtgcaaagtattcagttctagaatgcatgagatatatgacaaagccaaaaaattctttatagttgataaataattgtggcaaaaacagctgtatagtaactttgcaagcatcatttgattaaatgcttaaaaagtcttgactcagttttaactatttcctgcaaataatcaatatttaattaaagctactccaaattagtgacactttacgtgtctgtctttctccctccccttctcccttctcccttcccccttctcccattctcccattctcccttctctcttcttcctttcctcttcccttcccttcccctttcccttcccccttccctcttctcttcccctcccccttcccatcccccatcccttcccttcccccatccctttcctttccccttcccttccctcctcttcctccttcccttcccccttcctccttcccttcccccttcctccttccctttcctcttccctttccccttcccttcccccttcccttccctcttcccttccccttcccctttcccctccccctctcctcccctcccttaccttcccatgaaatgagaaagcctcagagatagtggcttgattaatttttctttagattaagatatttgtctaagcctttaaggtttatctattgagcttttttgtctcctatttttatttttcctactatgtttgtcgaggataaaatacagcactgtgtgccaagtcataatcacttttcatttgagacttaattaaaatgcctttattttaatgatatatttggctaatgtatttgaagtaatccgaaattaagttttctaatgacaaggtgagaaggataaattccatttacataaattgctgtctcttctcatgctgtcccctcacgcttccccaaatttcttataggtgtctgtgatcaaagttttgggattcatgttgcagagcttgctaatttccctaagcatgtaatagagtgtgctaaacagaaagccctggaacttgaggagtttcagtatattggagaatcgcaaggatatgatatcatggaaccagcagcaaagaagtgctatctggaaagagaggtttgtcagtttgttttcatagtttaacttagcttctctattattacataaacaggacactaagatgaaggttttttgttgttgtttgttttcctctgtgtttctagtgcttattttttaatcagtttttttgatggcaaagaatctatctctgtgttattttgatttctgcagtatatacatctgcatgatcaatattcgatttcaagtaccaaagtaggagtaaaggaatattaacctaggtttaaaattagtcatttcactaaaattagttattatggacgatagatgtctaggtatatctttgttcataaacgaatatatcaagttcagttattaaattacacattaggtaagaaaaggacaaagaaataaaaaagcatgattcataattcctgccctctatttgtctagaatttagttgggaagataagaataacgaacgtgacacagagaataaagtggcatatgacaaatatttattcaagaaagctatatgtggacgggatgtttcagttctcatgggagaagtggattttatggtgcctttgagtaatgggtcatatttgggcgttcacacagaaagacccaagcatatgcctaattttttattattattattttttatttatttatttattttttagacggagtctcgctctgtcgcccaggctggagagcaggggcgcgcgatctcggctcactgcaaactctgcctcctgggttcacaccattctcctgcctcaggctcccgagcagctgggactacaggcgcctgccaccacgcccggctaaattttttgtattttttagtagagatggggtttcaccgtgttagccaggatggtctcgatctcctgacctcatgatctgcctgccttggcctcccaaagtgccgggattacaggagtgggccactgtgcccggcccttttttttttttttttttttaaattagaggattactagttctcttcaattataaaaataaaagaatcttatttcactgcctggtcctggaaacatgtactgcaatatacattgtgacaactttttacctgtcatgtttttagcttttacctgtgaatgtcttatcattgttcttatctgaaggatagatagttgctacaataataatagatggtgtgtatggtttttgagcctaaaaagtgtagttttatctgttgtacctatacaagcaggagaaatataacttgttaataattttaggtatggcaggctgccatcctaaatatgaagtggtctttgtatttgcactttaatgtgttgaaatcatagctttcagtgatccaggattaggcagactcttttatgcaatctcttgtttccagttagaatagaagtcgtgtacttttgataacattaattataatatattttgagccctgtgaggttggtaacattattcccattttatgaatgaggaatgtgtgttaaggagtttgcccaagagtcacatagcaagtcatagtcatgctctctgaagcagcaataacttggcaataaaataaaaatgaagcatcttctgtatgtgttaacttttcagtgactgtttatgccttccagtattctttgtaaaccttgaattctttttttcacagatgattaaagtttatcaattgtaaaggtggaggaatttgggaactagacagtgcacacataaataataaatatgttcttcaaatattgggtgggctaatgtgggaggagtttgagaccagcctgggcaacatagtgagaccctcgtctctaaaaatatgaaaaataaaaaaaaaattttttaaatgtgtgatatgtttagatggaaatgaaacaatttgtcactgtctaacatgacttttagaaaagatattttaattactaatgggacattcacatgtgtttcagcaaggtgaaaaaattattcaggagttcctgtccaaggtgaaacaaatgccctttactgaaatgtcagaagaaaacatcacaataaagttaaaacagctaaaagctgaagtaatagcaaagaataatagctttgtaaatgaaatcatttcacgaataaaagttactacgtgaaaaatcccagtaatggaatgaaggtaatattgataagctattgtctgtaatagttttatattgttttatattaaccctttttccatagtgttaactgtcagtgcccatgggctatcaacttaataagatatttagtaatattttactttgaggacattttcaaagatttttattttgaaaaatgagagctgtaactgaggactgtttgcaattgacataggcaataataagtgatgtgctgaattttataaataaaatcatgtagtttgtggaatttgagatgcattgtagttcttcgcagtgtgacttcaaatattttggaagaaacaaatagctcagagacctcgtaaaatatcttaaactggagggctccatggagatcattgcgagtgactcccccagaatgtccatctgttgacaggagccaggctggctgcatacgaattagctaaggagcttattatatatccagagtcctaccgtgagcctccatcccgtctgccattctcccatccctggtctatgataagacttagaaatctggattttaacaaaacgtttcagattgagaaccttgatttagtctacttctcctattttacaataaagagatgaagcggttaagaattagctaatcctacgcaaagtgagggaaaaaggacagtctttttaataaatgcggcgggctggtggggtatccatataggaagaaatgacattggacccctactccatgtcatatataaaaacctccactttgggaggcgaagcaggcaatcacttgaactcaggagatcaagaccagcctggacaacatgacgaaaccccatctctacaaaaataaatgcaaaaattagccgggcatagtggtgcttgcctgtagtcccagctactcaggaggctgaggtgggaggatcacgtgatctgggagaggttgaggttacagtgagctgcactccatcctgggtaatacagtgataactgtgtctcaaacaaaacaaaacaaatcaccttcagtgatttttagaccaaatgtacaaggtaatactctcaaggttttaatgttttatagttctgcagaagataacataggaaaatatttttatgtccttggctttgggaagaatttaagtcacagaaaaacaccatccataaagtttgacttatttagctatttgaaattaacaacttctattaaaaggcaccacaagtgaaaagacatgaatcgtaatggaagaacatactggtacgttataaaatatcaaagagttgggcatggtgtcccatgcttgtagtcccagctactcaggaggctgaggcaggaggatcacttgagcccagcagttcaagtctcagcagttcaagtccagcctgggcaatatagcaagactgcatttcttttcttcttcttttttaatacctggaataaagaactcctataaaatcactaagaaaaggggtcacttaagaatctcattaacaaaaagaatttgaatatttttccaaggaagatatgcaaatggactgtaagcacatgaaaagatgcagatcagggaaatgcaagtcaaaaccacaatgagctacaacttcacactgattacgatagttaaaatcaaaaagtcagatggtaagtactggcaaggaagtggagaaattgaaactgtcatgcgctcttggtgcgaatgtaaaatggtgcagctgctttggaaaacagtctggcagttcctcagacaattccactccaacgtatatccaagtggaatcacaacatatgtccccacaaacttgtacataaatgtttatagcaggattattcataatagccaaaaggtggaaacaacccgaatgtccatcagcagatgaatgcataaatgaaacgtggtctatccatacaatggagtatattattgagccattaaaggaatgaagtactggtacatggtgcagcttagatgaaccttggaaacattgtgctaaatgaaagaagctggttacaagagtcaacacgtatgatttcattcatgtgaaagttcagaatagagacagcagtagagacaaagtagcagttcagggttggtgccagggaatagggggtaggtggggtgaaagctaaaggatacggtgtttctttgtgagatggaaattctaaaataggtgatgtttatacatgtctgtgaatatactaaaaaccattgaattgtacacattaaatggatgaattgtataggaattatattttaataaagctatttaaaaaaatccagacacttcacccaagaggaaatctaagtggtccataaacatgaaaaggtctttaatcaccagtcagaaaaatgaaaatgaaaaccatgccaggccacctcccaccaccatagtgacaagcatttcaagtgtggcagttccagctgttgttgaggatgtggaataacactggtaggggtgttaagattatctggtgaaattgaaaagacgcatacgacccagcaattctgctcttaagtgcatactctggagatgcttttgcccattgtgctgcgagatgtatacaagaatgttcctaatacctccacactggaaacaactcatcagtgaaaatgaactacagctacacaaaatgacatagatggaatcttaaaacgtttagtaaaagaaatgatacaaaaggatacagtttttttttcatttatgtgaagtttaagaataggtggtattgtttagggatgcagtctttgggatggcaactgtaaagaaaaagtgattgtgttaatcagagtgattgtctttagggaaatggagtgctgatggggagggggcacattagggcttctggagggccacagttctggtttttaacctgagtggtggttttgcacgtgcttgctttatagttagctgcaatttttttttttaatgcagttaaagtttggtatgagaacaaatgtatgaccgatgagtcctttcagtttaccaagttctttttcgtcatcgttaatttagagtgggttacatcagtttttcttttctggctgccaaaggcttaggaaaaaggcaaactgacagaggaagattttaaatgtagaaatatttattggtttacaaatccttttaatcacttatacatgaaaagctttcatataattcaaaaagcaaattttaaattccaatgaaatagttcatcccgtggttgtgaaagagtgtttttagattgctgcacagaagcatgtttaacgtggaaatcagctcatggttttagttgttagggctacaagaaattgggggagacttcattccaagaaaacatgtagtctgtcaggctgttttcattcctctaaaagagacagttttctaagatgtttttgaaaatgagaaaatacgtaatagatctgcttaagaagtttcaaacttaatctgtgcttattacatgaatatgctaatgtaaaaccaggccttcagttagtgtttccttccttttagaatggtgtatgtaaagcaaaatataaactaatttctgacctgtcaaaggttttttcttaaaatttaaatttataatgtggtttggtttttctttcccactcaaacatgaatttgggtaataccagaataaagctggatatataaattttatccaaaatttagaactctgttgttaagaaatctgttgaccacataaccatgtttctgagaaaatacatgattttttgcatctttaaaaaaaattagcactaagaagctaagatgaagttgtttttgtaatttgatttttttttccttaaaatactgttttggagttaaaagttgtagcaaaactggtataagaaagatgttttaagatatatttaagtcttgtctcatactctattgactaagctagcccggtgactagggtagatgtatttaaagaataacttttcccccttaaaatctcaatattccacatcctgttagacttcttgagtattaaatacatcttctatccttggtctttctgcatttagcttttttgggaagtatgtttttacccaagcatatggtatgagctgctgattcagtattgagtggctctttaagcttgttagttacattctgctgattaaaatggtgtacagaatagtcaggaaaaaccagtccctggtctgaaataaacaatgttaattagcttatggggaagaacaaatgagtaaggagaattttcatatacaaaggaaatctctgattgtctttctggactcagtgtgtttgggttaaggagatagggtgcggctggagaaaatgatgaaaatgttcagaatgttacatgtatttttacactgaaactggaagtggaagcccagtgtgatagttttctgcccgatgttggcctgtcttcacacccacaccacttatcttgattgatagagctactacttcctcttatactgcttcagaagttaacctctgtggtgcagtgctaggatatcacagaggaaataatcccttgtagacagtgtcttgttgctgggagttatcagtgcctcctgttctctctaaggagggcaatgggaagccctttccttgcatttgctacagccgtttccttgacctccctggaagaacagtatttcatggtgtcagacaacattcagaacatgctcaaattaaatgtatgtcagtatgcatttgctttggtgtgtggtttgtccaaaccaaagtgcccatacatgtctctggtccagccatgtgggaaattcagcagtggggtgaaccatatggaaatggcaggtgttgggcagccttgactggactgccctggtcttacttctggatttggtgagtagaagatcacactgttgcttgctgccctgggttcacctcaaagagggaaagaagaattagcaacttaaatggttaaatttagaaacaagaaaaagttctgtcagtgggcagtttcttacgtctaacaaaaaaaacaacagcagtgaattcttttgtgttcagaattaaccagtaaacacaaccttagcaattaacctatcactatcacgattgtttatttcctggaattttgttgacagaattagtccaataaatgttatgaataataattttatgaatagagataggttaatgccaaattaagtataattgaatctgagacattaatgcaactgttttaaattcaaccactgacctgcaatttttatatgccttgtccatccagcaagatacattttgtccatttttttcatgtttaaaatttaatatttattgtcaattccagtgtgtttcattgctaaacatcaggctcagccaaagcaatcacgaaaatgactccacgttgaatctttaacatcacaatgtggattaacaatttggcaacatttggctgggcgcggtagctcacctataatcccagcactttgggaggccgaggcaggtggatcacgaggtcaggagatcgagaccatcctggctaacacggtgaaaacccgtctctactaaaaatacaaaaagccatgcatggtggcgggtgcctgtagtcccagctacttgggtggctgaggcaggagaatggcatgaacctgggaggtggagcttgcagtgagctgagatcgcgccactccagcctgggcaacaacaacaacaacaaaattggcaacattaaatactttgtcagtatctgaaaagtgcaaagtactgtgcttggctccccaaaggctcctcttaatcctgaaaggcaggtgcttttattatcttttatcttattatctacattttccagatgaggaaacgtaggtacagaggtttagtaacttgcccaggtcacatagccagtaagtggcagagctgggatttgaaccccagtaccctatctccagcgaatctgagatgtacatgtgataaatttaatctttctcaataaattattaagtgtcaaagcaagtggtatgggcaatgcaccaggattaagaaaaacagtgtgtggtaaagatgtaaaatatttctaattctgttgtgggctgtggcactcccgtggaaggcttgccacagacacagccagaggcatccacgtgggcccctgctgcacacctggtttgctgctaccaaggctgctctcccgaggcttgttcacacaaaggaaagtgagcagctaggaagctgcatatttgaaagttgactagtcaccaaatgctggcatccaaccaagtgattgcattgtaccctgtttggatgaaagattgtgtttaaatgaaaagagagatgatgagccagaagtgtggcaaatgagttaaaataaattgtcagcagtgtttgaagcaggttgctgagggctggtgtcctgaaatccggtcacttggaggatgtatatgttccatcaggggccggaaatgttttatccaagctttagggaataaccctggagattctcttcgttactctactgttaagtacgtgcttacggagtaaacttcgcatgactaaggtttacaggcctgaatgtgcaactgagttcaagtaagcagcaatgtggtgtattaggaagactgcttgacttgggttctaatccttgcttcaccacctagctgtgtgactttaaacatcactgtttttcctcctgccttccttctgtaacttaagggggttggattattagagttctcaaatgccataccttcaaggccaggtgcaggatgcagagaatagtgggttaaagtgaacacctcaatgtaaaatcattcaaaaatttaaaaacatcacggaccaaacaaatatgtctttaaatctgaatttggttaaaggtcacaagtttatgccctttggagtactctctgacattttcatgatgatatgaaaggatttttccatacatactcaaaaggcgctcacgcctctgttgcagtcagtctggccacttccaaatagccaccccatgttggtctccacttcttccctccctctttaagtgctatgttaataatctagcttataattctctaatcagcagtagagcactttgctactttattttttattgttaggggtgatcttagcagcccaagtatgctaagtcttagaaatattcatcagtgatgtttttccctgaagctcgtttggtgactgctaaactagaaccagaattggagaaaaacgaccctgtgaattccaagccaacaaagccggggaagaggcattgagcaacctgtggttgcctgagaaacaaaaggcaaggtggttggatgaaagcaacacttccaagccttttccagcttaacgaacataagtctaggttttggggagagcctatcttagtgagagtgaacaaataaagtaggctgtatctttcagaattgggtatgactcaaataactttttttttttttttttttttttttttttttgagacagtctcactctgttgcctaggctggagtgcagtggcatgatctcagctcactgcaacctccacctcctgggttcaagtgattctccggcctcagcctcccgactaactgggattataggcgcccaccagcacgcccagctaatttttgtagttttagtagagacagagctttaccatgttggccaggctggtctggaactcctgacctcaggtgatccacccccctgggcctcccaaagtgctgggattacaggcgtgagtcactgtgcctggcctcaaataactttcaagattgaataatagtagcttgaagcaagtctagagacgagccagctggaggacagggccagcaggaaggaggtatgcaaggaaaaacctgcaatgaatggacctactgtgtttgagggtactgagaggagtttggggttgaattaatacctacaaagcatccacaaagcaattgggaagaaagggtagggggactattaggcctagtcatatcaaacttttttttttttaaaaaagagtaaatgtcatgatagtatactgcccacctcaattgtaaaattttattttatttcgtttttagatggagtcttgcactgtcgcccgggctggagtgcaatggtgcgatctcggctcactgcaacctccgcctcctgggttcaagcaattctgctgcctcagcctcccaagtagctggcattgcaggcacccgccaccacgcctagctagtttttttgtgttttttgttttttttttttttttttttttttgagacggagtctcgctctgtcgcccaggctggagtgcagtggcgggatctcggctcactgcaagctccgcctcccgggttcacgccattctcctgcctcagcctcccaagtagctggcactacaggcgcccgccactacgcccggctaattttttgtatttttagtagagacggggtttcaccgttttagccgggatggtctcgatctcctgacctcgtgatctgcccgcctcggcctcccaaagtgctgggattacaggcgtgagctactacacccagccaattgtaaattttattcatttaaacaccaacaagtgatttaagaacaataataaaataactgtagctggtatgatggctcatgcctgtaattccagctactcaggaggctgaggtgagaattgatgaggccaggagttcaagaccagcctaggcaacatagtgagacccccccccacccccgtctctaaaaaaataattaaaaaaaaaataactgggcatggtggtagtcccagctacttgggaggctgaggtggggaggtttgcttgagcccaagagttaaggctacagtgagctgtgatcactgcactccagcctgggtgacagagcaagaccctgtttctaaaaaataaaaattatattgggatgatggaaaggtataaatctgctctttctgtaagatgatgtctaaaattggaaaataaatagtggtataagcatgttatttaaaaatttagaggtaagtgatagaggattgtgaaagtggctacctctgggacagtgaacagggcagcattgagaagggagctgccatttttcatcataagcctcatgatgatcctatttgattttttttaaagatttgtgttcataaaaatgaatattgaaagtgaatgcaggaaaaaaactgtctaaaagtatatttaaacagtgacattcactttgcacattgacaccttaagataaatccaatgcaatgtcatactcttaccccaaataagttgcattgtaatgtaaggtcattctcttggggagaatctaaactgacagaaaaatctgtcttaaggagtacctatgatcacaaagtacttcaagcaccctttaaattgtgattaaagataatttgttgtttagaaatatatatacctaggtctggggaggaatagaagggaaatggagagtgactgttaaggtttctttgagggatgatgaaaacgttctaaaattaagttgtgataattgcaaaactataaatatattagaaaccactgaattgcacatttaagtgggcaaactattacggcatatcaattatatcccagtaaagctgtttaaaaaatagtagcataaataagatgtaataatagccaacatttgttgggagccaatagcctgagtgaccagctcagcattcttgataaccacccccttctccctatctcctttactcaataaatatgaagggctctagaagctcagggcccttgttccctagaagcaaggagcccccgaccccttcttccaaacacactcttttgtctttgtctttattcccatgttcatcctcctttgttcagtccagcatggtctgtggcaaacattcaacaatctctaaggtagataatattatcccattttataaatgaaacgggcctagaggagctaaatgactttcttaagaccatcagacatgaatagattagaaattatttttctttcatgtaaaagaagtctggaggtaggctgtctagggctagtaaggtggctccacgattatgcagcagagaccctggaacctttgagttggtttctccactgtacatggcttctctcaaggtcacctcatggcccaagatgactgccagggcttcaaccaatgcatccacattttaggcagcaagaacgatgagagtgcaaagatgcttatcccacctttaaagaaacaaaagtacacagcttccacttgcatcttccatgggagaactgagtcacacatctatgctgttggagcctaggaaatggagtcttcactcccaaaactcattttgaaaagcattcgcgttttgtgaatggcaaggagtttccggtttggtgcttggtaaatgctttgagatgatgatgtctcttctgcccaccatcttcacagcctcacctagtctttcatatttatttccgctcaaagcttcatttggcctctggtcttccttctctttctctcacagcttttttggactctatcctgtaatcgcttttccactgaatccaactaaacactcagtaccttgtctgtctcgttcatcgtgctaggcacagtgctaggctctcaggaaacatgcatggagtgtaggttccttgggggatgtgaattatcaacacccttgagcatggctggaacgaatcgcccctcccgaggacagacaggtagagccagagtgcagggcagtctcccagctcgctggaggcagagctggcctggagcctggcctcctgaccctcaggtgcctcctctcaccctgagcttcccaaacaccgatttccaggcaaagcctcatcacacaacgatattaagtaaagtaaaataggaacggataataaatttttatgtatgcagaaattgtttctctcctcccctcctcttggggttgattaacttagctggaagtaatgaacctgaactgattttttgagcaccagatctaagtggtaattactgagttggtaccttgtttatagactttcagaagaccgtaatacttactaagagaatccttttctcctctactcccaccagtttctcccttggcatgagaaccgacaaaccagaacataaatgagctggaggagagagccctttcttttttttctaggagttgtgtcatatttctaaagggcagcactgtaagtactctgctcccttcagggaagaaattgtgcttccaggacccctcactgagagcaacgccagggaaagaatggccggctcaggacttccatcgcggtcattggccaaactccttccttctgagaatcttactgacagaggccccagggtcatctcatggggctttctgaggccagtactgctttcttctgactttcctcagtagacatctatggctcttttaatgacattctctctccaacctgcttggactccatccacatctttctttgggttcctccttctatgaaggagactcctgtttgtcctcaactggcctctcctggggttcaaaggcagcccttccttcgagtctctcgtgggttcgtgagcactctacctgcttgtttttgggtacttggtaagcccggcatcacaatctcccctggagctagtcccatggtgacacctgcccagattctgtggtcaccagaggtttcaggtgatggttcagagagggcaccgtttcccgggaggcttggggacttggcaattcatgggctttatattctcttgtatatcccacctgggccctggaagcccagtagctaagtgaggagaggcacaacctcctggcctgaagctgagttgcttctattccacctacaggttttcctctccctgttccctctcctggagcttccagatctctgccaccctgtccccctattcaccccagtgatacaggcagcccgagggctgagttctgtgacagcaccctcaccacttcaaatatgctgacatcggttcttcaggcctgggccactcactgagcaatttgatcttccatttatgcctctgcccagctgcgtcctgatcggtggctctggcctgctctcttcttgtcctggcttcagcccttgcgcctgcctctggccagccgagcttcaacagccagagcaccagctcctgcacaggtcgaggctcaagccgtggcagggccccttccccaagcagtcttcatctcatgtagctgtgacagtccttggatgatccgagctgggaggggcttcaaacaactgtatcaagttcaaacccttgatttaaatgtgaggaaaccaccgacccaaggccacacaggtagtgtgaggtggccattgccaggaaaggagggatgggcagttgtgtgccccatcctgagtgtctctggcagctggactggatgaccaccactaagccttccacaaactcaaatctgctttgacagtgaggagatacctgatgtcttgtttgttccccagtccctccctgtctttgctggttgctgctgctaccaatcacatggcccgttgtcctgcccacagaagtggaccaatgacccaagccatgtcatcagctttagattctgggaacgagaagctctccttcctccatgattattgagcttgtatgctgctatagccgtctgtgggcataccccacctctacctcttctcatctttgtgtaccctacccagccatcccggggagcctatcagcagtgggaaagaatgagatcaacatagacgaactattccatgttgatggggaaaggggcatggtggagcaaaagtgagctgagcacattattggagtccttgggctacgtcagggagtctctaggtcaccaagccaaccagttcctttttggcttaagctgctctcttattctcctacaccaactgggtatccaacaatgcaacccaatcctgacaataactatccggacggcataggttaagggcttggtcccacaagactgtccccacttcagacatcagctgcaaagaaggtgcccaggctacccacatttctgcccaactgactataaatttgggggttcccaccagccctcttcatgtttgataatttgctagaacaactcaccaaactcaggaaagcactttacttactattattggtttattataaaggctaaaactcaggaacagccaaatggaagagttgcatagggcaaggtatggggatgggagtaggggtggctcagaactaccatgtcttcttgggatgcattaccctcccagcaccttgacatgctcagcaacctgtaagctccctgaaactttgcttgggaattttttttttttttttttagattccattaagtaggcatgattgatgaaatcactggccattagtgattgaactcacactccagactaggtgtggtggctcccatgtgtaatcccagaactttgggaggctaaggcaggaggattgcttgaggtcaggagtttgagaccaggctagccaacatagcaagacccgatcttgacaaaaaagaaaaaaaattaaccagtcatggtgatgcaaacctgtggtctcagctacctgggaggcggaggtgggaggagccaaggaggttgttctctcttgagattggagggtggggctgaaaattccaaccctctacacacagggttagttctggctaccaaaccctgtcttgaagctatctagggtcacctcattagcataaactcaagtatagttgaaaggggctcattataagtaagaaaatacacttccatcattcaggaaattctcagggttttaggagctctgtgctaggaaatggagacaaacaccaaacaaattttatataccagaaatgctataagtgcagtttctgttgcctgtgaccaaagggtccctggatggttcaggcactgatggagccagaatgaaaacccatgacaaccaactcctaatgggcctcatgttctgtgaactactcagattccaaatgcatcaaagacaccactattgaaggcaagtctgattgttttgtgggctcttgcagaccataaatgtagccttgcacgcgtgggtttgatcgaagtgaggttctatcagtaacatgtgactatgcctctttcataggttgttgcttcaaagagaaaaataaccacttctgtgctgttctatgtgtacggcatccagcatgggtgctcaagtagaatgaaataaattcacccaagggtccctactctgcctctgcacctcagacctttaacctcatttgtagaaggagggtgacaatcgaatcgatgtaatttacctatctactaataatcagaactcttttgctttcaggtgagagaaatgcaacccataccaccttctaccctaagaaccatctgaggttaggggtgctgatcccaggcccagctgggttctaaaactggaggggggcatgcggcctcatcctccctcgcttcctctctcatcctgagtgtcatctttgtctttcggttccttcatgtggcaggggacgtggccactgaaagcaatagggtcagatccttacagtatcttctttttcttttcttttttttttttgagatggagtctcacactgtcacctgggctggagtgcagtggcacgatctcggctcactgcaacctccgcctcctgagttcacgtgattctcctgcctcagcctcccgagtagctgggattacaggcacacaccaccatgcccggctaattttttttttttttggggggacagagtcttgctctgtagcctcggctagagtgcagtggtgcgatcttggctcactgcaacttctgcctcccgggttcaaataattctcctgcctcagcctcctgagtagctgggattacaggcgcctgccaccatgcctggctaatttttgtacttttagtagagacggggtttcgccatgttggccaggatggtctcaaactcctgacctcaggtgatctgcccgccttggcctttcaaagtgctgggattacaggcatgagccactgcgcctggcccttacagtattttctcagagggaaagaaggcctctgtcttcaggggccaccttagatcccagaaggattctgacacctggaccagaggcagagaccgccagggcaactctacccgaaccaagaggaagtggggacagatactctcctttgaccaaaactttaatgaggctcgtctgagaccttcctgaccaggcccagcctatgtccttgcagaattcagtttgagcaagaatcctgccgagtcagggcagggaaacgcccccagccttggtatctgaccactgtctacatcttatcagcctgatctgccttcagcaagagtcctattgggttggtctaacaggattcccctctccccgatgttttctctcagttattttccattcactgacctccaccctgcttcatggctgcaagtccccacttgcccatgctgtagtcagaatcgagtgcaatctctccccacaactgcaagaccacactgcagtgcagcttgttcctctgaccatggctccccttgtgtagtctgccttactatccataacaagtgtcatgaataattttttctttaacaatacccccctccaggctgggcacggtggctcacacctgtaatcccagaactttgggagactgaggcaggaagatcacttgagcccaggagctcaagaacagcccaggcaacatagtgaaaccctctacaaaaaatgcaaaaattaatggggtgtggtggtgtgtacctgtagtcccagctactcgggaggctgaggtaggaggatcacctgagcccagaaatttgaggctgcagtgagctgtgatcatgccactgaactccagcctgggtgacaagagtgagaccctgtcccaaaacaaacaaaaacaataaaataaaatatccccctccaaaaaagtgaagggttgacagtctgaggaaaacagcttgtgtctgcacatatatatttttttttaggtagagtctcactctgttgcccaggctggagggcaatggcatgatcttggctcactgcaacctttgcctcctggttcaagtgattctcctgcctcagcttcccaagtagctggaactacggggtacatgccaccacacctggctaatttttgtatttttagtagagatgggatttcaccatgttggctaggctggtcttgaactcctgatctcaagtgatccacccatctcagcctcccaaagtgctggggttacaggtatgagccaccacactcagccatctgcacatttctttataggagacttgtgaggattctaggagagaaggcatgaggaaagctgagtacagtgtccagctcccagcaaatcctcaaccaatgtcagttgctgccacaatgatgacggcagtggtgatgaggaggggaggtgggatggggagttgggagttaatgtgccctgtgctttgatgagggcggccagcgtgtagcccagtggaactgcactccagcctgcaagctgctacatgccagggtgtgtgtggtttgtctgctcagaggggtgccttgttctacttcatgctaaggcactgcaggagctctcaatggtcctgggaaaaagaggatctccttgtactaaggtatgaagagctaagttcctttgctcatcaaaggccagaagtggggaaatgattttaatgtcttgtaagagattgccgaattggagcacaatttgcaactgatggtgtagtgaaatgagaaaggttttggaaaatcatttccaaggccccagaagctgctgagcctggatggctttctaagtgggaactgaaactggcccagttgtcctatagaactgatgtttactgtttttttgtttttatttttgtttttttttttttgatagactgtagaaatggagcctcctgctctgaaaggttgaaacttacatttgtcttatctgagttccttcctcaggaaactgaccctcaggcctggcagatgttattaggaactgaaacttaccagatcaccacatcagggcaatgagacaccagacccctcacgcatcatgattgcctaagcaaccatctgttgtttgaccaactcgttttccttacctctccctaattcctgttttcccacatgtagttacaattcttccctgccacatgaactcctaaattcagctggtccagctgatcaatttgagactgatctcccatctccttggctgcagcacccaaataaagccttcttccctagcaatgttccttgtctcagagatcagctttctgtgcggtgagcagcaggacctagactgaagccctggtgtttcggcaacagaatcagccgcaggcatcagaggcagtgggcacctaacaatattctgttgttttgagcttggggatccaggcagatcctttgcctcctgaactcggctgagggaggctctgctgagtgaggacggcaaacatctctcagaagggaactaaaatctattgcacacttggtttgtggtctacactctgcatggatgatctaatttcatctgtacacaaccggtaatgctcacagacaagaacaaggaggctcagaaaaggaaagttattcactcaaggacactgagtcgatggaaggaaggaggactggcttccactgtgcctcctcacctcctgggagtggctcacagaacagtcacgatcactgtcactctggcactcagacaagctggttgtgtaggcaaggtgtgtgaagtcctcacagccaagtaagataatacacagagatgtatatatgtatgtatttatttatttattttgagacagtctcctctgtcatccaggctggagtgcagtggtgcagtcatggctcactgcagcctcgacctcccaggcccgagcaatcctcccgcgtcagccggccaagtagctcggactacaggcacacgccaccacatccagctaattttttatttttcatttttaacttttttttcagagatggagtcttgctctgtcaccaggctagagtgcagtggtgtgatctcagctcactgcaacctccacctcccgggttcaagcagttctcctgcctcagcctcccaagtagctgggactacaggcgtgcacctccttgcctggctaatttttgtatttttagtagagatggggtttcaccgtgttagccaggctggtctcaaactcctgacctcaggcaatccacctgcctcaacctcccaaagtgctggaattacaggcataagccactgcgcccggcctatttttctatttttatttcttttgagatggagtcttgctctgttgcccaggctggagtgcagtggcacgatctcgactcactgccacctctgcctcctgtgttcgtgtgattctcctgcctcagcctcctgaatagctgggcctacaggcatgtgccaccatgcctgtctaatttttgtatttttcgtagagacggggttttgccatgttggccaggctggtctcaaactcctggactcaagtgatcctcctaccttgacctcccaaagtgcagggagtacaggtgtgagccactgtgccctgcctacacagagatttagaaagctaaaaggactcacccaaactcacacacttgagaagtggcagagttgggtcttctgtctctaaatctaccacaccaaacaactcaactggcagcattttctcagcaacatctttgcaggaaccttgtggtcaattcctcctgcaggggtgagtggcagcctgcagagagttctgtgagtcaagtgtttcaacatatggatggattgttgttttttactgtggcaacaaaaggtgtgagatttttgtctttcatcagctacaaactacactgttggtcaggcacttttactgggagatgtttttcccccgattcttcctggggtgacttgaaatgtgggcaggatccaggaggtggagagagaggggtctttgaaggggtggaggtgggctgctgacactgaagagctctcagctgattgactcacctgcacatgactgtgtagggaatgtctggcccaaggaggcttcctgtaatgtatctatcatctcttcatttagctcattttttgggtttcagaatccctcgtggaaggtccatttaaaatcttggaagaaacctgggctctgcagattgtcctcagtggagcaactaagagctgaatacagtaaaatgaaaggcaagacaaagtcatttcctgggttaggataattagaatttgagtcaccttcctgtgtaaaaggaaacaaacattctgatggtcttcatcagggaaagagaaatgttttatcaaataaagtgtaatcctggcagttggcttcaactgaggcttgaagagaggcccggggtgtttaatctcctgacattttccctgtacctcttttatgacacttttcactttttgccaagttatttataccatagcctttatagttaatttttgcttctagattatatatttccacttctgtggacaacttgcagcagtttgtgcatagtatgtattcaaaaaatgaaaaaatataaatacatggatgaattactgaatggatggataggtgagtgaatggatggatgagtggatggatgggtggatgagtggatggatggataaatggatggatgggtggatggatgtatggatggatggatggatggatggatggatggatggatggatggataaatggatggatggatggatggatgagtggatggatggatggatgagtggatggatggatggatggatggatggatggatggatggataaatggatggatggatggatggatgagtggatgggtggatggatggacggatgagtggatggatggacggatggatggatgggccctggtcatgttcacataagaaaggttgaacttgtgggagaggaggcaaaaagaggaagtgatagtcactgaatgtgtgtgctagacagtatgtctggcactttataatcattttagttaatcctcacaacaatgcaataaggtagattgcttgtttccccatttcaagatgttgaaactgattctcagagaggttaaagaatttgcttaatgggaccctcatctagatcagtctgaatagaaagaactaccagactcttaaagtcagcctagcaccaagtagacactaaaacattgatttttgtgatgttgtttcccagaaacattgagtcagaaagcatgtggatgcagattaaagtggaacaggctcggccatgactgagcatctgcaggaggagctgaggaaagagctggcctcctcaaggcctgggtgactcaactgtcagcctccaaagcccattcccctccttcattggagaggagtttgaggacagttgtggttgaacccccagcaaaactattccaaaacgccgtgtgctggggcaggtggggcctaggccaaggccatttggccctgcctgctgtggcccttctcccctcccatgtcttccagccttgcctcccccacaggctgcagatgacacccttcgcagtgcttattctggagtgtaagagctgagagcaggagctacctgggggttgaggggtgggcaggctttagagaaggggagagaagaggcctcactgtgggagctgggggctcccaggagccacatttgccaggcttggcttcaagctgacatcactatcagagaagacaggtctggggaatgagagggcccaggagttcaggagcccaaactgtcattcagttttggaagccgaatccccagcacaattgtccaccttgctggcagcatcctggttcccaaagcctgtcagcccggggctgcgggcctctctctcacaaagccttgtctaggtgacttgggaggtgaggcccctgttggtcagccccgttcctgatggaacaagccaccctaaccgctctgtcctctcaggtcaggcttctgacaagccacaatgtgggtgagcctttgtgcactgcctgcccacctctcaccaggagccctctctccccatggcctcaaggtaccagtgaggcttttttctgtctcagcctggccataagcagccctctgcaagagttccgttaccagtcatttgcattgtagtataagtggaaaccacagaatcgccttcctccccagttatttatacttcaagtcatattgtagagagaaaatttctgtcagcaaaaatctcaggaatcctcctcatttctatttgtatggctttcaatcgttgacatgattttttcacatatgtcatcttctggggatggattcgtataaccctgcttcacttgcttccctgtgggaggctcacttgcttctcgacaggctctggaagaactaggcagtctggtacatggttgtgcaagaacccttgagggggccttggagtgtgtgcttgggccctggaactcatgcctaggatggagggctgagattgccccttcccatccaccagggagttgacaagggggagaagaaacttcttgtgagcttgcgatgacttgtggcacttgcatcagaccttggagttccctggggagaggcactcttgggtatgacactgtatagtgccacctgattgccatttgacccagtttggccctggatccttgagcaagagggctggaaagaaagacaggcccactttttgggacactattagggtctgtagcattggtggggagagaattcccccaacccccaaaagagctgaaaatgagacacgcgtggaggggtgaaagtggagtgtggtcaacagtgtggttacagagatgtgtgtcggggccactcccactcaccagggagactcatgaagcagaagggatggggcacaatgtggcttccataggcacaccaagccacctggagagcgcatcagccctttgggtacccccaagcggaaggaggttgggtctttgggtctgggaactttggtgcttgttctggtgggaagggcagggagtcaagaccagctgtgtcttccactgctcttcttgtccactttggttactggcctctgttggcatgaactggggaggcagaggctacctacagacgaggaactgtgtggagtgcgagtgtatgcagtaaagggttagcttagctgacttgaggtactcacacccatattccgaagaaaagactggccctcagcctgagcctccgaaataatctctaagcccttagaataccctgctttgtattcaaagagtatctttgaatgctgaacttagaaccactctagaaaatgtatgctaacaatgcgatttatgatgaacacttgtctttgttcccctggggccctgggccacattgtatcagtttgagccctagagggacagagaatgagaaactaagatcagtcatgcaggtgctccaggcctatgtgaccaaccaccaataaaaaccctgaacatcaaggctcaagtgagcaatacagctggtcccaacttacagtggttcaacttgtgagttttgcactctacaatgggtttattgggacataacccagtggaggaggatctgtacttcattcacatgtgttgtcacatcattactgggagaattaagcactgtccacgtgaatccactgggagaggataactggaagcttgcacctggcttctcctggattctgctctgtacgcctttttcccttgttaattttaatctgtattctttcactgtagtaatctacaactataagcagaatagcttttctgagttctgtgagtctttctagtgaatcattgaatccaaggtggtcttggggacctctaacaaaagatgtctggacctgaacttcctgttgtttcaaagatcctatagcaggctgtcttaccaactttcagcatcaagaagctggtggagagtgggttagtttaaaaatgaaactggggagagagatgaagccgggggaagatgccgtgaaatctcaccttataggcagcctctgattcacctgagggtttttccttgaatactttctgggtacaagtatttgagacaggtgatgtgctggtcactttattctcagctgcttgtggcctagccctaacatgggcactggaaacaatgggggtaggggttgatgatggagaaatggggagtaaagggatttaaaactttgaaaaactgagctgtttccatgatttgtctcttttgattctcacaaaacctttatgaaatatgtgctgacattttaagctctcacttatagtgagaaaagcaatcttcagcaaggtgatgacttgtccaagggaagacatggtcgcccttgttccttgggagattttgtgctcccaggggaaagcataagccctcaggagccatgatgagaacagctgtagaacagcaagtgaacaggtgtgtatcagtcaggataggcaaggctaagctgcagtaataaataatccccggatctcagtggcggaacattgaggaggtttatttcttctttatacaaatatgctgtggatcaggatgactctccaggcaactgtctgtgggactgtccaggtgggcttggatcacctggtgttgggccttgaagtcggtaatggagaggacatgttagaagagaaggaacttacaagcagtgggagtgcagcgcccttttgtggataggggtcaaggcaatgctttccaaggctatgacttggtgtggtcgaaaaagtcaagcagtcttcactttttgctgtggtcccagcaaatctgcttccaatccaggcttctcccatataaaaagcctcctttgtgtacagtgagtgaactagaacagggaggagatgccagtggagcttggcttgctccttctgtggccagctggcttgttttaccactgcctttggggtacagtggcagctgtggcaaatctctctggagtttctctagcgggagcgaagcacctaaagcacatgggtgcaggagcagccaggcctgcacccatagacatggtacagagaggagcagggaagcccgctgcctgcagacttcaggaggagagaggtaggggtggtgcaggggagagggccttaatgccttcagggaaaggagtcaaagaggaatacccaggagacaactagactttagaattcttggggccagaaacttgattccacctctagtgctttcttttagatttctttctctctttactttctttctttctttctctttctttctctctctctctctctctccctccctccctccctccctccctctctctctctctctctctctctctctctccctccctctctctccctctctctctctctctcctttctctctctctcttcttaagactgggtctcgcagttgggcacagtggctcatacctgtaatcccagcactttaggaggctgaggtgggtacatcacatgaggccaggagttcaagaccaggctgggcaacactgtgaaacccatctctactaaaaacacaaaaatttgccaggcatggtggcagatgcctgtaatcccagctactcaggaggctgaggcaggagaatcgcttgaacctggcaggtggaagttgcagtgagccgagattgcactactgcactctagcctgggtaacagaacaagactctatctcaaaaaaaaaataaataaataaaataaaagggataccgggtcttgctctgtgtcctaggctggagtaccatggtgtgatcatggctcactgcagcctccacctcccgggttcaagcaattctcctgtctcagcctcccaagtgagtacctgggaccacaggcatgtgccaccatgcctggctaatttttaaattttttgtagagatgaggtcttgatacgttgtccaggctggtcttgaactcctgggcccaagcagtcctcccactttggcctcctgaagtgctgggggtacaggcgtgagcctccacctggccagcctccagtgcttttgcatccttcctgttaacttgtgtaggaataaaacattgtcacaataagatttttttcctttttattgttttgattttttagccaatgagaaggaaaattccttattagggagggcgagggtgaggatatgtggggtggggagaagcgaacgttccaagtttcgaaaacagcgactctctcttggactctctagccagtagaaacctccctcccactctcttgccccaagatctggtgcttagaagagaatcaagggaagttggaacccagaagacggagacagattgagggactgctgtgaaatgttggggtgtttggtgaataatattagaagttgggctggcagagaccctgtcacataaacattaaatcaacactggagactgagcatttgttagaaatgtaagcgggaatggcagaaaacttgtttttaagggaaagcatgttacggcttatgttcagcctccatcctctgaaggcaaaagttagcaaagttgatgtatggcgttgctttttctgggaactttatctcgtttggtggggttcccatctctgtctcccaggagccaagactttcccctccctctgctccagcagaagccagtctcaggcaaggctccctgtacctcatttacactttggtgtgaatatgttattgtaacctctctcctggaggtgtctgcattccaagactgaacttttctgtgaaagttactgtcactgtgaaaggcagttcagcccccagggattgaaaaaggaaatcattttgggtaaggggacagttagtccagattttttcagttgcaagtaaacctaactcagccagtaggcaaagggggaaattgctggtttgaactggtgggaagaaagctgaggaaactcctacacttgggggaagaactgcaggtgcctggctgcagggaacgcagcgggggctcaggaccaggcagatgccctgcctctgcttcccttggcacagtggcctccttctcccttcaagtaggcagatgctgcctgtggcagaggacagcagctgattggcagcccagcagggaggatgtggtagacaggcactgagcatctcttctaccctccttctagagggctatcctgtactgttgaggctaaaagactgaaaaccacatttcccagcctctcttgcagctaccaatctggatgagagttagattctacacattagatgcactttagcaagattttcaaaagcagattggagaaggagcccatgcttctgctggttttttttgctggcaagtgaggggttctgtttttcctggagtgactttatcatggtggcatctgaaaaaggctatttcttgatcagagagacagcaaccctctcagtgacctagttctgtgggtgtgtctctcctgagagttaatcccagagctcaaactagagctcaaccctagagtctcttcaggcttcccaggggtgggggtgcatttaacagtccaagttaaagagaaaataaaggccattaaagaccaaacattgagcactgagtgaaaaagttttattgccaaacaggaaacctgattcaggccagggtcttggaaggttgttcaggatgagatgggggaggtgaaatggggtaggtctttgaaaaccaacagattgcaaattctctgtcccatagcaggaaaccacagtctctgatgtcagctggctgccaacacgtcagttgtatcagcattagctggctggaggtggcctgctgtgtgcagatggtacctggtgcaggattgtggtgtccaggtgtctctccttagcacataagaccctgtccgaggactgtggcatgacgtgctggagtcacgattctgtcacccagtcaggtcatcagtgtcagagagctaggtggccaggttggagttgattgccaatgataggtctttttctgcttaaatcagctggactggattctattgcattaacttgaccctgactcatgccgccaggcctaatttataaaccaagacaagaaagggctactccaccccctccaatttgtgtaaggccaggggacttcccccccactccccaacctgaggcatgcaccctcccttagatcaatggctgtttctctgagaatgcggaaccgtgattaatccagccttgatggggaggcagcaggaactgtaggcattctcacttcacacccatcccaatcccctcccccttgctgtcctcttgtacagaggactgaaagcacaacactctctccctccctcccttataggtggtgacgatcatgtgactctcttctggtcaatgagatgcagcagaaagtcctagggaggtctaggaaaagtcctgttgggagagagcattttttaccttctccctgctacttcttgctactagtaacatggatgtgagccttggaggggtagctaccatctggcacctggggtggcaagccaacatggaaaggatggcagagcgggaaggaggagccagccttaccgatggcatcactgtcactgcgctagccccagaccacctgctccagagttctggttatggtaatgaaataaaccttgatttttattccttaaaactacccttcaatgggttttctgttcattacagttgaatgctttcataactgatacaggagggaccctgtgattggcagttccactagactgcatggagatgggtggagttatctaaaagaacagagatagtgtccctagaagaaggggacaggaaagcatcctgggtacacaaaagtcaaggctccaggatctgccctgggggctatctcaacacccctacactctcaccgcacgtatttggtcagctatgaatatgaccaactctcgtcgtttatctctattcagtggaacacagcagcactgtgacctgcccacgagaagaaggatttttagaacttatcttagggcaattttaggtagaggagcagacaagatggtgtacaggagaaacaggtctattaaccctggtattaatattaactggctgcccagaataaatgaagaatagcttattctttgccaggttgaagatagaaaaggaatgaagggccggagaagtacagctgggtgaagcacagagcagcctagtgcttggcatgggactcagatctgaagcagcctctccgggacttctctgagcctgcccctggtggtatgactgtgatatccctgcttctatagttggcaaccaacatgtcctagctcctagaccatagagggccagattcatgtctcattgactgtgtaatctctgtgtggcccagtacagagcatgcacaccgtaggttctcacatatgtttgttgagtgaatgaatacaataccaaacgaatggacaggacagagctgtgggctagcaggaaggatatctggcttttgcttgaattagctagtgaattgctgtgtggcctccttactgagcctcatttccctctgtctgcagagtcaagcaaatcttccattttttgttcccctgctgccagagcatggcagagtaaatgtgtgagttgaagggagcaacctcatgaggttttgctttgtgtcttaattacagccatttgtggaattaggcttttaatataaatatttgtgtgcctgcgcctgcatatatgtatttggaccaatgctctcatgtgtgcaaatacatgtattctaaagaaatctgtccagaaccccagcatctgtggtgtctgtggtgggaggggcttccatattacagagagatgcccacagtgcatgacgttacccgcacaggtgtgacatcacagggtaaccaaatgcttttgccctgggggtgggagagggatgggtgcacggtgaacagcaggtgggggtctttccataggggatgaggaagacaaggccacttggaggcagaggagaccacagtggggcatgatggttggggaaggccttttacttctgccccttaaggatgccctggaattcaggctttcggatcccagagctctcattagagcagccctgcgttgtagacttttctgcagtgacagaaatgttctatatctgtgctatccaatatggtagccacaagttacatgtggctattgaacacttgaaatggggttagtgcaattgacgagctgaaaatgtagtttaaattcacttacatttaaatagctgtgtgtggcttgtggctgcctattggactgtgcagttctggagaatggtactttacttgtccttggggaagcagaaacaaatgaaaacgaggatctggagctcatgaagtttctcatggggtggggtatgtgtgttgaagctgcaccttcagcaggaacctggccagtccttagtggaggacatttctttccatcctgcatccagatggctggtcctgctcctcccagtccatggagaaaaaagaattgaacaaactgtctaagctgggtcaggtactctgcagatgtttgctgagtatcgttcttgatggaaatccccgtggaactcctacattttctcctctcttctccttcctttcagaacctcagagtgacagagccaaaagaccagtgcctcattttgctgacatggaaaaggaaacttcgtgggggaaagagatctgcttgcagtcggccagagagacagaaccagggcagtggtgagctctcatgacctggtgtctgttgccttctggttaagtttttcatttgtaattctacaaacatcccttctgtaaacatttccctcaaaatggagcaggaagctctcaaaaatggaccagaaaggggtcaggaatataactttctctgcccagattccaggacttacagtgagaaagcgccttctgggaacttcacaatggctaaagtgtgctaatgggatgatgtgcccttgtacacccactgcctctgaactctgctctgcattgctgagcaaactacatttcccagaactccttgttggattccttccaaacaggtttaccactgggagagcctgttggttggggagggcaggaagagggaggaaagaggaagggactcacttcctgtttccagctgaagtctaaatcaatccactatcaacaggtagctatcatactaccctcattgtcacccctcagaggtcccactgcagctgcataatgtcccctcagtggcctgaacatgagatgaacaacactcttcttgggagtaccagccttgcttggttcatggccacttttcctgattatcttgcagctatattaggtcatgtgacaaagttctggccagtggcaagggaacacaagtgataggtacagatagaagtgtctgatactacatagattatgcttgcactcactcttaagagagagacatgaacttttaccaacggaagccagtattattttgaacctctgttagagtggcttgaatctgtatcctaacttgtatccctaatgtgtgacccatgaaaattagccaggcagcaccagttccaaagaagctcacactcccctgcggctgcttctgccaaggtcactgatatttccctttgctaaatcttgtgggtgttttcttcagtccttgtcttaatcactcagtggcacttggcacttattccttcttgaaacccttgtttcccttggctttgtggcatcctgtgctcttggttttctcccatatctctgaccctctttccttagtcttttttcttcttcctcctgtcccttaaatgctggttgtgatcctctttttatctcattctacacactcacagcctgagtaattcacaccatcttgatgctgagaacttccaaaatgttggtctagcctgggtcattgttatgagctctagactcacaaggccaattgcttggtgggaacccctcccccatggttatctcatgggtccctgaagtccaacttctccttcattgaactcatcacctcttctgttcctcctcctgggttcccaggctcagtggtggcaccactgtctacctggctgcttagcctgagacctggctccgtcccaattcctctctctcagtcttatcatccccatccaggcaaatcattgattctgtggacctactctttcgggtgtccctcaaatctctccacgtctctgtgttctcactagcactaccttggtccaccctgccatctgctttcctcctccactcctgcattctgagtcattttcggcagcacacgcatccttaaaacccctccactggcttgccagtgtcctcaggattaggcgaaaagtctttgctttgttttacaaggcccttcgctatctggccccctcattacctcccttgctctgcatgctccagtcctgcagaactacacacagttcccccaacaaggccctgctctgttcttcccacacactgctcctctgcctgggccactcttcctgctccttgtcagcaggcttgctgctctcaggctcagcatggacagctgcttctgagagccttctctgcctacccaggctgggtggctgcctctctttggtgtgcccatggcagcccagaatgcctggtggacagggagccctcagcaggccgtactgcagcgccctgcccccgtcagcctccaggagcctggagtccagggacatcaagggcggtcctgtctttctcacccttgtctctccagcccctaacacaggggatgcctgaccccaaactagacgagttacttgacctctctgacccaagacaaaatgggaggaaagtgccaaatttccaagattggccaggggattaaataagataaatatgcaagtctcttatctgggggtctggcttggtaaatataaagttcttttttcttttcttcctttttcttttttttttttctttctttttgagacagggtcttactctgtcaccaaggctggagtgcagtggcatgatcatggctcaatgaaacatcgacttcctgggctcaggcgatcctcccacctcagccccctgagtctcttggactccaggcgtgcaccaccatgactggctaattttttgtatttttagtaaagacagggtttcgacatgttgcctaggctggtctcgaactcctaggctaaagtgatccacttgtctcagcctcccaaagtgctgggattatagacatgagccaccatgcccagctaaaagttcctttttaaaatctgcttgttagatacactcatagaaaggtaactggccacagaagggagaggaatggcagtccatccagggatcactggagtgtcatatgaaatgttataggaatcacaggccttagaacttgaaaggaacccaaggatcatctaggctactttatgcaggtaaaacagccacctgtgcccatcacatagctggggcacagctggagaccccaacagagaggagagctgatgggtgacgagaaatcaggcctctccgccacggcagcctagctaatgggtcttggctggaagctaacaggaaggcctctttccagaaacactgtaagccagtgtttctcagattgctgggtgtaattcataggcagatcatgaaatcagtttaatagctttgaccagcattaacctatttatgcctagcgttcccttattggaacactaagtctgtgagagttatttacatcctactgcttaaggtcatcgccaaaatctgattttttacacaaaaaatttgcaacctccagcataaatgggttaaaacaagacaaaacaaaacaataccagaatggaaaatagtgcatgatctgtacagtatagttgtagaaaacttcttgttttatcatttgatgtcatgaaagtccctgctgtagataaaagatggagcttgtgcttctgagtggtcatgctcaacagggtggggagcccaggggagtggggagtgatcgtatagacagaggtgggtggggccagtgtgagcctgatggtcaattacttctcatttctagggaaaattgaaggaaaagaaggagggggatgtggaggggagagaaggcctcagtagagtttgcactattattagggcaagtaagctgcttctgaaaagaaggggtttgcaaagccaacccaggcaaaagcaatctgctggaagaacttcatccccagctgacactgtgggaaggaccccatgcagaagcaatagggcagcctggtcccatatcctcatgaaatgcctcttataattgtgacatcttgcaattgtggaggactttacacttttcggagttcctagcccctcacttatttctcgtaagaccgctgggaggtggggggatggtatcatcatcccactttagagatgaggaaacaggatcagagtgagctaaatgactgccagatccaaaactagaattcagacctcctagtttctaagtggacgctctttctacaccaccataatgtgagtgttctgtgtttacagggtgtattcaagtccatgactgcccattagaatccccccaaaaaattccaggactggcctgagttgctccttagaccaatgaaatcagactcctgggagtacggcccgggcctcgggatcctttaaagctccatttggagagcctcgggcacagccaggttggatccatctcccagtcccccagccttggctcagcctggccaagctgcccaggaggtcccttggtgccctgggctctgtttcactgttgttttgtagagcaacttcccagtgatgctgccactgggccccatcctaacagtgaagtcccccgggccctcctgagaggaggtgtgaactggaagatggggaggcaggcggctctgacagacagaaagcaaacagctcagaggggtggcaggctgcattttattcatcgttaatttaaacacccttcaagtcctctcttggaatgctgctcagaaaaatagatgtattgtttgagaaaccctgcaggcttgtcccgcatgctctagccccctcctgagagaacagatagcataaaaaatgatttgtaaagcaagggggagcttccttagggaagaaggggaaggggaagagggtttggggccaggtccgagtgcagaaatcctcaatgcatgagactagcgtggaaggtgtagcaattgtgctctggggtgcctgaaagtgccagagctgcttcaggggcaagagtccaggccccaagtccatgctgatgagcccaccctgggggtcaggaatggcctcagcaggccctccctccctccctctccaccctacaaagtgaggagccttgagtcaccaccagcacattatacaacaatacaagaaccctgcaacagataaagccccagcgcctcttctggactcagatgccctaggctggctgtctggctgtgctttccagacagtgtgtatgtggaattgtgctttttgttttttaagaatgtaaaaagttacagtaagatcgaaccacagggcccgtcgctcctatggtctctgcctgactgggctgccgtctgcctcagttccccagaagcttctcctttggccatgagggctcagtcatccctcaccccagagtccacaggaagagggggtctgctgggaggcctgtctgaaggacggaggatcctgggtcaatttagcagctattttccagggtttggcttgggtttggatgctggcttctgtgtgaaacctgaatacatgcaaattgtacataaaactcccccaaggcagagagggattttccaggccctggtacatctctagagagttaaaaatgggaaatctttcttcttaaagtggcccagactgagacttttccttggggaaaagggttagtagctctttgtaaggctggtgtgtatgtgtgtgtgtatatatatatacatatatgcatgatgctgtgcaaatgcccagggctgtctggcattttccacaaaatgagagcctgagattgcctaagccttctgatgccttctccaggcctggaggcactgcttcattcagaggacacaaaggcctgaccacctggctttagcaagctaggacacccagggtggcttctttacctttctcctcagctctgagaaggctgctagccaagactctggattctctgtggccacagtcatatggtgagggcctcttggagttcattcaaactttaagggagccccacagcaccggcatgatgggtaagtccaggcctaaggttaggaagcaaatcctggagcatgaggaaattgtaggctacagtgagctaccagtggtgtgcaaactggagacccccaagacagtgagagaggccacagcatctgagggaatggagctctttcttggcctgaggttcagaagaacctgcaccaaagaaaggcatccctatcaatgtcactgttcctgaaatgatgggagaaccacatccctgcttcagggaagcagtccctgtcgtctggggcgctgagccctttggcctgagatgaaggatgatggtgtgatgtatcatggcagtgtgactgagactggattgggggatggggacaggggaacataggcaaaaatacacatgtgccactggatcctgagctgccattgtaccttggaggactggcgtttctctgggaagttgggaggtgggaagaggaagggtctcattttcctgccccttgaaaccatgcttaccattcctttagaagattgctcaagctgcctccaattgcctctttccaaaaccaaagcataggaaaacaagtaaaaacagctgaggctgcagcataagcaacttaggatagagtctaggaagcaccgccaacagagaagactgccaagaaacattttgagtttttcttctctggaggtgggtcctggttcctcccatggagaccacgattctgtgtagtcctgcacgctgggcgggggattgcctggaggtttctttagacctgtctagctcacacagtcttgatgcctgggttttaggctgctgtactgttgctggggctcacttcctgtgggtaggctgttattttgcccgcagatcaagtcctcactgtctagatgcctctatcatggggatctcttcttccctctctggatggctctgatccccaagttatttcctgttgcctaggtaacacctctaattggatgccttttaatcgttcccttttttaaagggataaatgtggattttatttccaggtcctgtcagagggccctgccctagagaacacgtgcgcccctgcgtgggcaatcccttcactgtgaccgcaaccatgggttggatggggggcactcactgggctggcctgacagtcacagtgaatcctgaaagcatggttttcacaggaacccaccttcaggatttagcaagactgacgtctctcctggccagcgctgcttcactggcttcaccccagattagggcctgtgtttaaaaaccaatcccaactcaaatcagaaattacccaaaatagctggagagtcactgagatctcaggtaagctttcccttcctgccatgaactagaaggggaaagaagagtttgacattcaagtttgactctaatgctgggtgcgtgagcgcatgcgtgcatgtttgtgtgtgtgtgtgttccacgcacatttgccagggagagagatttcacagcatggctccagctggaggcggtgaggcggtgcttttctaagacttcctatcagaagctgtgcatactggtgggtcacgccgtgcctgtataaactctggcacctgtccttgccctcatcatatatgagaaaaatgggcagagagagtgttcgtttacacccccagaccactatcctttcaatgaagcctgggtatctggccttcctccaggtcagggaccccctatgctgcagaaggcaagtctgggagaatctgtccctcagcccgagagcaaaactgtaatcctaacattacttccatccaccagtttcaccagctacctccctcctgccttcctctgcctccaataggctgtgcatggagaagacaaatcctcttgataaacaatatttagaaagggattctatctttcctgaccccaaacacatcatggcctctggagccaaataccctgacatttgcaagatggcttcttttgggttcctggtgctgcaggccctggttcccaaggacgcagctggcagaggtgcctccttcagaggaggaggaggagaagctggagggctgcgcccggcaaccccatgatctcttaaagggggaaaagttgaactgatcaacagtagttaagaaaaaaaaaatccacaccaacaaataaatatcttgtctgagaagactcagatattcctggttaatattgaaaagcactgctgtggatgagcttgtgaaagaaaggacggttgggggattcaagatctgccgatccgagcctggagatcagccagctaaaagcccagcagggctcctgcagcctcaccgctcccctcctcacaggtgccctggaccgcccaccattagaagtagctgccctgtgctctgtgctaaatggactaactctgagctgagaaaggccagctaagcccctcaccactgcaatttccaaatctgggggaaatgccacagtccgcaagttggtgctatgtttcatctcattgcataatactacaccattctctgtgtgtagtggctgttctatatatatacatcgggaggcaacatatggctgtcccaacccccacctgtcaaaactgtgactatatcacttctgacgaccagaaggaagctgctaggctgggccaggattctaaatgctgaggaggtaattcagagccacgaaaagttgcaccatatgctttggggttgccggctgcttctgtgcatggggacggggtttagtgccagtctgcaaaaccctcctcgctgcggtatgccctgggtgtgggcctggggggccacgttttctctccctgaaggagaatctgctgggggccacggttctccaagaggggactcacaaggaacacaggcgtccccaaaacctgcccttgataacatcaggcctggccaaatagtatttctttaaaaaaattttttttgtttcattttattggataaagattaagaaagcgccagcagtgactgagagaagcaaaccacgcccggcggccccgcggcctggagagggtccccggcgcgggcggacgggcggtctacctggaggcgctggtctcggccagccggttgttcatgatgcccagcgcgcccacgccgcccgagaagccgttctggcgcgtgttgacgcacacgctgcgcgggtagccgttggccgtctccgacagctgcttctgcagcagcgccagcgacaccttgttggaggccgtgaggtcgcgcatggagatgagctcgcccgagaggcggcggccctcggcgtcgctgtcgcgggccgcggggtcggcaccgagcgcggccaggcggcggcgcagccgggagcctggggtgatggcattgcgccgggccaggggcgcgccaggagccgggcagcagcgcgcgcagcagcggcagctcagcttgcgcagcatccagttgagcacctgcttgatgaggatggagatgacgttgaagagcgagtaaatgcagcacacgccgagcaggatgaagaggaagttgcccaggcggtagagcccctggttccggtaggcggcgtgctggctgctcaccaggtccccgaagccgatggtgctgaaggtgacgaagcagaagtagagcgagtccacgtagtcccagccctccacgctggtgtacatggccgaggcgcagcaggacagcagcacggcgaacaggcccaggatgagcagcacgtggtacaccgagggcttccagcccgccaggctgtcggcctccgagagcgcggagccgcggcggaaggtggcgggcagcaggccgctgcggcgcagctggcgctcccggcaggcgcgcatgatgaaggccagcagcgagatgatgcgctccaggaagaggttgaagaacaggatggtcccagcgcagccgaacagcccgtaggcgatgaggaaggccttcccgcccaccgtcgcgggggtggtcatgccgaaacctgtggagacagggcagggtcagcgcggtcctggccgcgcaggtggtcctcactgggcgagggtggggggtgtgggggcgggggcatgcaggtgcttgcgcggctcctatctcgagtggcaccactcaggtggaggaagaacagcacttagtcatttatctcccttggtggcacttaataggtttcctgatcttggcagcccctaaactgatggaggagacatggcccttcatcttggggacctataaacccaagtggttgggacaggtagtcactaggaaggacccatcatgacacaaaaaatagaaaccactgctgcacaggtgcaaaccactgagctacccacaaagccaacaagggacacctgctctcccactcctccaaatttttttttaaaaactgtcatctttattttagttcataaatacattaatatactagtctaggtgagttttgttgggtgaattacaaatatttacattagaaatcaaaaccaacatagatctcttcaaagatatctagcttcttatgtgcttgtgcactttttataccagtcttgttacttggaaactccactgcctacttgagaatggtgaaaaaagccaagtaatcttagtgctgtgactaattttcactttacaggcacttcgaaaaggcctttggtcaaacgatcatattttcttttttggggggataggttctttgtcacccaggctggatgcagtggtacaatcatagctcactgcagctttaaactcctgggctcaagtgatccttccacctcagcctcccaagtgataggactgcaggtgtatgccaccatgtccagtgaattctttgttattttttctaatggcagagaaaggaccatattttcttagtctgccaacatttcatgcctctggaattgggcctaaggccaagtgggtagtccgtcacttccctagttcttacagtgtgaatatggggtgacaagaaaatgtgcatttcaaatcaattcccagatgactccaaagtcttacatactagaatagcagacttttctgttcaaagggcagtttttaaagagttgtcatatgtgcccaattttttttcccaagtgtgccatagattttcggtccctccctgttattaaaaaaaaaatcagtttaccaactctgcctactaactaaaggaccccaaaattaagtgtcagtgctcaaaagtcaactgcagctcctcttctttcctcaagttatttggaattgtgagtgaatccgagccgaacaactgttgactacgagtttttctccaaaagcctggtttttaaatgtaacctgtagtacacctgggcagacagccttgttagggaagcattccatagggctttgccttaattgggattgttcactctgggaccaggtagagtgtaaccaggtagctagagttaatggtctctgaaaagagctttgtgaggctgacaaaaggattgcttgagagtagtccacccacacccttcagagactgagcatggctctgccattgggtgccggctccttctcaaccaaggatcaccatcagtcatccttgctcacacttgtggccaaagaaaggctctggcccagctgggtcctgtgctgctggtatatcaaattgctttgttctgggaggtctatacaactgcgtattgcttcaggcccttatcgttgttaacttaccacttgttcaaagcacaggctttaagggtgtctttatcaattgatttctgcagaaggtgtggctgcctgccagtgtgctcgcccatgccatccagggcagtgcagagtggcagctctgcctctcaactgagctccctgcccagtgctggctgtggtctgtgggacccgtggttgcctgactctggttatgggagggggtttcatctcttggtggaaagattcacttactgcttggagtctgagctgaaaaaatggatcatttgagcagcaccatgatactgttcagcaagtctggcagcgatcaggggcatccctgtttaatttgtgccctatggcagaagggctacctgtgctctgccagtggggtggggccagccctgggaaagtggagaagagtttgtcctatgtggcttactagtttcctaaacagactatagaaaatatttcttgtaatactttcagagtacattccttaagcctatgtgctaacaatcattttctagactgtctgaaggaaatgcccagttgcccgagtgtggtgttgatcttacgcttaatgactcaggtgaggggaaaatcttatgatgttacccatgttgaggaagatggattatgtccctagatttacagaaagtgaaaaaaaccaaaatagctgtgtaaccaagaacttgatagagggattttgctacattttaaagccacactcaagttcttgagtttataaagaaatcagctctgaatttacatggctataagtggagtgggagtatatgtgtatatttataaaacgttttagaccagtaacctaaatgtctaacaacacaactaaatgattgtctattcataaaaaggaaaactatacagcaattaaaaagcatgaaccatagctacttgaaacaacatggataaatctcacaaaaagaatgtggaacaaaataagctggacacaaaataatacattctgcattattccattaacataaaattcaaaatcaggccaaactacagccttttttagggatgcatgcatggttggtaaaattataagggaaagcaaggaagtaattttgataaaagtcagaattgggatttcctctagagcatggcagggggtagtagctgagaggggacataggggacctctggggtgctagaaatgtttttgttgacctgggtggtagttacatgtgtgttagctgtgtaataatctgttaaattgtatgttttgtgagtttttttgtactcatagtgagaaaaaaattttaaacttctagactgttagaactctcagatacccaattctgacgtacccatcactgtataggtgagggagtaggggctgaggggctgtgacctgcatgttggggacagactcccacctctttgtcctggcttcaagcctggtgcatagatcggtatacagaacactgcatctactcactgagggaacacaaagtctcttatagaaggataactctgttaaattcctaaggtaattgaaaatcctgggcctggaaaaccaatactttgtctaactaagaaaatactgaattggatttttcagctaaagcctcaaagctgagaacagtatgtgtacatttctccccattctaaagagaagttccagacacatccatgctggacttaataaaacagcaaaacaggtctggggctagcaaccccccacacccccacctccaggctgtacggaaaggctggggattgatgggatcttccatcagttgggaagttgttatgggtagttgttgtggcagtggagagtgctgtggattctttcactcacccccaggccaggggatggttggagcagggaaggtcaagaggacttatggagtgtcagcaagagcccggcagctcacttcctagctggctgggcacagccgctcacaggcctacccagagtggagcatggtgagggttctgggagaacccggcagtgtcccctggagtccagagctgtgctggagagttctctgggtgggaggctgactggggcagcccccacaggcaggggaggaagagggcagtcccaggggccatctgtacttcaagggcttgcttcatcaggagatgtgagggtgacatgggtcaccagagggtgacaagtggatactgaaaggaagagatctgaagagactgctcaagagggctgcctgctggagcaagggggccctaggaagaagaggctgaggggcagagggctggggacagcatgagagggagtcacaggaggagggatggagagggcagtgcccactcagggaatggggcagggagtggtccctgtgcagggctcccaaggacccataaatagatgccgtgaaagcacatatgcctgttctaacagggagccttgcagccccaccagcaaaagttaagaaggaatgatagtggctccagtgatgtaagatcacccccatgccccatccactgcgggtcccctgagccatgtgtcagcccagagctagagggggaggctaaataagctctgattagaagtgaatttgaagatttgattaaacaactgagaacgagtctcaatcttaaaactggtacttaattaacaacaacaacaacaacaaaagaggccgggcgtgatggctcatgcctgtaatcccagcactttgggaggccaaggtgggcaggtcacttgaggtcaggagttcaagaccagcctgaccaatatgcaaaaaccccgtctctcctaaaaatacaaaaaaaaaaaaaaaattagccaggtgtggcggcgggtgcctgtagtcccagctactcgggaggctgaggcaggagaatgccgtgaacccaggaggcggagcttgcagtgagccgagattgcgccactgcactccagcctgggcaacagagtgagactccctcagaaaaaaaaaaaaaaagagaaagaaagaaaagaaacaaagaaactggctgagcctggtggctcacgcctgtaatccccagcactttgggaggccaaggtgggtgcatcacttgaggccaggagttcaagaccagcctgggcaacttggcgaaactccgtttatactaaaaatacaaaaattagccgggcatagtggagtgcacttgtaatcccagctacttgggaggctaagccaggagaatcgcttgaatccgggaggcagaggttgcagtgagccaagatcgcgccactgccttccagcctgggcgacagagcgaaactccgtctcaaaaacaaacaaaaaccccaaaacacaaaaagacataaaaactatttggataactctagcatttacccaagatgttaaggaatctaaaagggagttcttaaagacaatagatgagacaaagccatttccagtgtcggcccatttaataaactggttccacctggattttctcttcattgtggtgaaagccaccacctaacaatgctggccctgcctgcatcatcgcatgtcatcatgacaacctatgggggagaacagctccattcaacagatgcagaaactgcaggttaaagggtgaaaagcagttgcgaagtccccacagcttggaaatggtggagccgagactgaaacccaggtgtgctagcatctaaagttcatgctctttccaccacattagactgtattctgagggcaccaaggaagctccatttttcttaagaaaccaaattgcagtcctccaggaccacagccaggggagcatcttcgtgggagagtggctgctgctcagagttgtgactcccatccttaagagtcctctgtcctctctggcctcctttctactgatcattgctgtccccttcacaggggagaggggccatggcctatcccctaaagagtctgccaaggtagactcataacctccccgtggcacagctcagacaagctgggctatttacataagacttgacccagggcttgaggacagcgcgaggaatgaggtgcagaggagactgctgcttctgggtgacagtctgcctggctgaccacagctggggtactcattggcctcttgaggccccccacaggcctgccctgcctgacctactcttgtgaggccaaggccatctcctccactctctgggggcctcttctgactcctccaaactcttccatgtctggactcctggcttctgcccaaggccatctattggagtttgggtttccagttgaggatctgcctttttcctggatgaccaaacctagaatgtgaccggcctcatgctccctcctcacaagggtgtggctttatccgagggcctcagcaaggcaaccaacaccagacatgaagctggtaagaccaacatccacctattcattccttcagcaaacatttactgtggacagcatcaggttggcagtatcatgcaaggctcagaaatatggtggaaaaccagacagatgcagttcctgtcctcagtctctaggctgccttcctagaggcccctcactgggtttcttagcagttttgtacagatcctaccccctttgctgccagcaggctcacctctgggacagggcgcatatagtctgggccagaacttgtcctggggtcttcttacggccctggttcagcttgcattcagcataacaacttagctagggagtgctgcaggccccaaatgatgctaaatactagactagctgtgtaacaccatctgcccagaatgaagggacaggtgaggcagaagggtctccgacagcgcacagggcaaccagtgaaagcgtccttactgtcctgttcctgaggtctctctgtgcctgctttactgcccttcgctttcctacagagcacactcagctcatcctgggagacaaggtgggggtggaggatggtccatccttcttccgcatcaaggtcagtaggttcagagctctgggggggtgctgagaccctgggacaggcttcctgctgagggcactggggcctatgcttgtgccactgcctagccagttgcctcccagagtagagaagcagtctcccaagctcttgcaatttgtggggagccaagctgctctggagaggggcctcaaagcttcagccagagaaaaggcaaacccagccaccctgagaatctcctcctccccctcaatcacaccctgcagaggcgtgatctgtccctgggttcgcaccaagcctgctattttgtttatgccacaattgatctgccatcccagtttgcaaagagcagacacttgggggctttattatgccactttgacaaaagctgtgaagctcgttcccacagcctgtctggtgccgccttcgcaaatggggccctggtgatggggccttcggagttcagctcagagagcatggaagtgagatggagaggccagcactgatctgtatcgtgcagccctgggcggcagcctcggttgggcccttgacacactcctcccatccaggcccccagccaccctgtgagggaggcactattacgcccaaaaatgcaggcaaggaaatgggctgagggaggggaagcattcactgaagttagtttgtacgtggctgagctggccctgaagcccatgccctttccacttgccagacagatgggaagtcttgactcattacccgctggagacttttcctgctgggctctgcactgtcaactgtgagagagggaaataaaacgtactgtacagtccaatctgggatacttctgagagtgaaagtggctctactagtaattaccccaggacagcatgtataaaccagggctgttccaagcaactgggacacatgattaaaatgcagattccatggcaggtcccgctcagaggtttatttagtgggtcagaaaatgggcccaggaatttcattttaacaaatgtctccagataaatctgatgtaaatggaatattcctttaagaatgccattcctttaagaaataatgttaataaggtattccagatgaccctattggttggaatctgtccaactacaaatattttgatttaaatttccattgacctaaaatttttgtggtgggcactgcagctctctccttaccaatcattctcccagcctgtactatattgagtagcagccaggctacttggagaacagactgaactccaggaatgggctctattagtctaggccaatcaggataatccagttccttaccatgactggctcaagaatgggtagacctaagtcaatcagtgcagagcattttcatgactacagagaaaccatgggaaggctgaggcgtggactcagtgggcagggatggaaaaagactcagaaatactgggcatggcccatggctcattagggttgccaggtaaaatacagaacacccagttaaatatgacttgggtaaacaagaaatcattttttaagtataagtatgtcccaaatattgcataggacatacttatactaaaatatagttgattatctgaaattcaaatttcactgggcatgctgtctttttatttcctaaacctggcaaccctactcatgactccacttgtcagcttggtacactcctctgagaagcttctcccaatattcccatctcatttgatccttcctgactggccagtgttgggattaagagcctcactttaatcaaggaacccaaggctcacacaaggctgagccctgcccagccaggccagcggccaggcctccccatgtccctctctctcctaacagggaggagtgggagatgggggagggctgtgggatggagggcggggctgccaacagcctgctccgtggctggaactgcgacatcgcctctctgggagtaggagtgggcttctggccagactcagtgggggaggactggacacttgagagggcactgggccaaagacttccctgggacatgtgccccagccctggtacctcagggctgcacatgtcagccatctccatgtcacacccccggggaggacaaccgaccaccgtggacaagccctgaaccttttgggaaagctggtgctaaaagaatagctggagaagtcactactgaggactgaaaatgcggagggtataataactgctgttgtgtatcgagcctcactatttccacgcaccgtgccaagtgctgcacgcgtatcaattcatttaatcctcacaacaactgcatgaggctccatgttttcactgattccaagtcacagcttttttcctctcatgttaacatctctaaaatcgtgcatcttacagtcaatggcctgatagtttatttggcagtattttaaattcctaatggtacgtaccatgatggtgtgttcataaccaatagtgtcttagatttgatgaactatagtggggatgattattgtccccagttgtgagattagtaaactgagttgcatttaacagataaagacattgaagttcagtaacttgcccaagatcacaaagcaagcacatggcagagatttgaaactagaggaaggagcttgcaatgtgataaagcagcaaatgtacaagagtttggaagaaggagaggtaggttgcttttggcaagagcagcaattctcaattctggctgcacaatagaatcacctggggaactgaaaataatccccaatccccgggtgcatccagaccagtttaggtcaacatcagaactgaggccttcctggtggaatgattaggaaagacatatggaagaagagatatttgtgttcagtcttaacaactgggtggggccgggcacggtggctcacacctgtaatcccagcactttaggaggctgaggcggttggatcgcttgagcccaggagttcaagaccagcctgggcaacatagtgggaccccatttctacaaaaaatttgaaaatcagctgggcgtggtggcgtgtgcctgtggtcctagctactcaggaggctgaagtgagaggatggcttgagccctggaggtcaaggctgcagtgagccatgactgcacccttgcactccagcctgggtgacagagcaagaccctgtttaaaaaaaaaaaaaagattaggtgggatttcaagagattgacagggagcagaggcctaggcttgggaaaggcatcccctgctgggacagtgcagtgcccagggccactgggcagggtgagggggttcagcctgctggtgaagcctggcccataggaaacgtccagtgactctggctgatggagcaggggaatctgtggaagaaggcaagggacaatgctggtgaggcaggagaagagggaattggggtaaccaaaggttaaggcgtaaaaacagtgggtgcagccagttctaggcaagattaggcagcacataggccacatcctcactcctgtgataagacagaagtttccacttcagcctctgattgattgtgggccaagctgtcacttcagcctctgattggtcacaggccagtccttcatggggtgtaactaaccctaggcctctaaagggcacctaggggtgctagcaaattcttttagctttataaaaaccctggggagaggcagaggttgcagtgagctgagatcatgtcactgcactccagcctgggtgacaaagcgcgactccgtctcaaaaaaaacccccaaaaacaaaaaacaatattcattcattcaacaaacatttatttgcacacggtgtagcaggctgtcataggcattagggatacagctttaaacaaaacagacaacattgactatcctggagcacacattctagtaacaataagcaaacaaacaaatttgtaaatagcataaaaaaaaaaaaccctggggagcactgcagtagagaggctcttgggccacctgcttgagtctgctcccactttgtggaatgtacttttgcctcaataaatctgtgcttttattactgcttttttctttttctttttttaaagtttattctttgagacaggatcttgctctgtcacccaggctggagtgcagtggtatgatcttagttcactgcaacctctgccccctgggctcaagtgatcctcctgcctcagcctccagagtagctgggactacaggcacccaccaccacacctggcaaccgttcttttgttgctttgtctttcattgctttattcttttgttgctttgtaagggtttttctattctttgtttaacgtgccaagaacctggacaactcacagtcaaggcgttccatctggtaacattgggagcacctcctagccacctgggactcaggttgaccctacaggagctttgtgaagtgagcattgcctggcacttttaggtgccagcatccaagcctagcacctggcattgtgccctgctctgtagaaacttctaggatctggtaagcctcatgttcagaagacaaactcagcaagtcttaactcctgcaggcttgggaagggcctccctcggagagctgagagcagaactaggaacagggacggtggtttcaggctctggcgcctccacctgctaaggaggtgacatggacacattccttaccttctcggaccctcgcttctccctctaaaaatggcccaatgccctacttatttatttattttttatttttttgagacaggctcactctgtcgcccaggctggagtgcagtggtgtgatcttggctcactgcaacctccacctcccaggttcaagccattctcctgccacagcctcccaagtagctgggactacaggtgcgtgccaccacatctggctaatttttgtatttttagtagagacggggttttaccatgttggccaggctggtctccaactcctgacctcaggtgatctgcccaccttggcctcccaaagtgctgggattacatgagtgcgccactgtgcccggcccactgccctacctctgaatgtcactgtgaagattaaatgaggatgtagttcccacatgcatcccacagtgcccgggacatagtaagctccccaaaagcaccaagcttagctgggaagcacgatgggtgaggcatggaccttatttcacagcaaagtggctcaggtgaggcaggcaaggaatgggcaaatcacgacatgacatatggatttccatggcagggaaatgcccccgtaggcacagtcaagcctggctctaccattggctcgccgttctcctacctcgctgggcctccatctccccacctctggctcacttcctgctttggcccctacgctgggtaggaggcccggctagaggttaggcaccatcttttccagtccccaaagtgagagtgtgtgtgtgtgggagagatatttttaaatggggctgttgtggaaaagctgagaccgtgggctgctctatttgttggcgcttgctggtttgtctgatttgcagagctggatggactgctccctgaggacagaagctcttggttttcttccctccgaagccaggcgtggggtgggagcatccagtgcacccctcttgcattgggtgcgcagtgatccggacagagaggctccagtcagccaggcacagagaaaatggccctctgcccctgttctgcttgtttttgtcttgttctctgggggcctttgaggtgactttcttcatttgatgacaacaagatgggaggcggggacagctgaggtggcaggagtaggggagctagggacagaggatgaaccccacaggctcaggccagtgacttctaacattagagaggttttggttaactgggagcaaatgcaagtgacttctttgaatcgactttgtacctcggcacagccttccttgctagcagggctgacttcaaccaccccccactctgtgctttatctctgggattaaggttttctctcctcaccagaaatcattcagcaaaatgagttattaaaagccggttaaccactcctgcctccgggtagctcccgtttaacaacctctcctggggagcagctgtcaagctcggccctgagctggcgggaagatgactcatttacatacagcccgtctccaggccccccccaccgccaccccaagatctgtccctgtctccctgatgactaatcctttccagggatgagatcactgccccttctaacccccccccccgcccccacacacagaaagagcagagccctcatctcagcccagaattttgggagaagactaaatccaagaccaagggaggcctttgatgggacaaagacgtgactgatgaacccggagtgaggagcaatgagatgaagaaagctctgcccacctaccccgtccctcactcctccctcccacctcagggcgctcatgtggggcttgtgtggggaacagctccagggtcataccacctctcagaagggagacagaccagccaggcgtgaggtgacagaccagcgggcagctcagagcagcaagacaatgtcaattcaatcactttacctcaattcctctatcacacaggaggagattttaaaaggaagtctctggtggtttgtaaagcaacaaatcctgctctcaagtggatagttccaagccctctcaatgaattcagttttatacacctggagaagcacagcctcgtcctttccatggagctacaagccacatctgggggcgctcagtgcccaggctgagggggcacgcagagccctcggggacgactcaatgcacagaggccactccttaagggcccggctccctcaaactgaggtgtccccatgcttggtcttcccacagaagccagcctggttggctgcttcaaaggaggaataaagatgaggagccatgatgcaaacaaacccacacctttcagctgcagccagggaggtgctctagaggcccacggagagctgtgtgtctgctctgctagcccgacctgcacctgccctatgggctggtaaaggggctgcccacagcacctcagcacatgggtctctctctcttttcatccagcccaaaatgtcaaagcacaagggtctctgtcagggcctggctgtggtcactggactgcggctgaggggtaaggtgcacccctcctctaatgggggcgcacccctcctctaatgggggtggggctggagctaatggcacattccactctcagctgccacacacagatggggaggttgatggcccgcacacaggaagtgagggatggtggggactgaatttatggagcccctatcccagaccaagcactctgctggtactttcacaggtgtaatccccagagcagctcctgggggaggtgtcattatgccggtgaggaaaccaaggctcagagaagtaaggcagcacaggtcccagccccactccacctcttgaggcctgactcagccttaggttcagagaatgcaactgtgatttttccctgagatgagcattcaatcatactgcgccagggtacttgctgtggccaaaacgcctgccctggatctgtggcatgactttgtgtcagaccctgtgcgatagaaggagatggaagctgaggttcagagacgttaatgaccttgaaggtcagggtcacagaaaatggcacaaccgggattgcaactcagttctgcccaatttcaaatctaccttcctgccacctccttgccttgcctattgtccccctcccttcatatgacctgggacccagactccctggttttctggaaatattctctctccttttggctcattctgtgcactgtcccagttggtggtattgaggcacagctctgcccagatcactctccagctcagctgccctgagctccccagccccacctttcaaggtcaggaatgacttatttccttttctcttcgcctgtctgaatcctcgccatcatctgacagcactttcagctcaccaggcatttaactgtgtgctgtcttgtgacagcccctgtcctgaccattgtcccagagatttaaccctttgtgtttttctatgttagcttgccagtgaggacatggcccatgtcttggacttcttgccaccctccagaatgcaggtcctcagggagcagctgctaaattcccaacagaactgacagtttgtccagtgatcaccagcagacactgtaccagaaacattgtctccatcttagtttcagttaactcaacatgtttttgagacctgctgtgtgccagacatgagggcaggggaaggaagactatggtgaataagattgcccacagacctccaggaacacacctgtagtcaaaacacaattgagcttactggctcactgcaatgaggaagcttggccaccatggattctggggcatctcagtcagagggtatcaaagagggctaattctaggagttgggcttgagttcttgagttaggtgatttatggaggacttaaggaagcaggcttcgctctggatgggatgctgccaaagagcggaagtacttctatgactgggcatcttaattcttagctggaagatgggaacgacatagcgaggccaagctgtgattggccaagaagcagcagttgctcatactaaccagatgagggatgtttggtctttttagtggtttggacgatgttcttgttttggtctgtgtttggacatgattatggggtgaatggtcttgtttttctctcactccatcttggtcataaggcggccttgcctgatcaggggttctgtgaaatgcttatgctccatggcagatcctcccagccccactgtgagtgccaggccagctctcggcgctcaggggctgccttcatctttctcaaaatgctgctgtgctttgcagcccataatagcattttactggatgccattcattattttttgtaaatgaaattctttccaagtgttccaatttacttggctatatatgtgcatgtgtgcacacacgcgtacttaattccgtacatggagcacactgctcagttgtgaaaatgggtgattttctttcttttttttttttgagatggcatcttgctctgtcgcccaggctggagtgcactggcgcgatctcagctctctgcaacctccgcctcccgggttcaagtgattctcctgcctcagcctcctgagtagctgggattacaggcgcccaccacgacgcccagctaatttttatatttttaatagagacagggtttcatcatgttggccaggatggtctcaatctcttgacctcgtgatccgcccgcctcggtctcccaaagtgctgggattacaggcgtgagccaccgcgcccagctgtgattttcattttaagtttcttctatttgcttttataaatatttcacattttctgtggtgcaaataggatagttgctacttttgaaaccgtaagttcactcccaacaagcactgttaagtttataaataaaaatgaataagatatgatccctgtcctcatacataatgaccacaatgccctatgaaaatgacagtaagggagatgtcaggggattccgggaagcaagagaagcggtttgggagggtgccccagagcaggtgccattggaactgagtagtgaagatgccttagccaggagatggaggcagttgggcacaaggtctgcaaggtccaggttggcattcaagggttcaggtgtcatgtggataagactttccagggagcacgtgtggtatgagaatgaaggcccctgaggaacttcagtatctaaagggcagaagaggagtctatgaaggagaccacattcattcaacaaacatttattgagggcctactgtggccaggaactgtgctaggcccttgggattcaacagtgatctaaaagacaaagtcccctaccctcaagaagcttacatttcagtatgggagatggaataataaactacaaacaattacgtggcctgtgagaaagtggcaagtactacaaaaaataaaaaatagagcaggctaagagggtgaggagtgtgcgggcagggaggaggcaggtcatggttttaagtggggtgggtccagggaggcctcgttaaggaacggatgtttgataaaggactagggtaagagtgtttcaggctagtcaacagcacgagcaaaggccctgaggcagaggggctggaaacagagaagaaaagagtgaaaaaggactgggcatggtggctcatgtctgtaatcccagcactttgggaggctgagacaggtggatcacttgaggtcaggagtttgagaccagcctggccaacatggtgaaaccccgtctctactaaaaatacaaaaattagccaggcatggtggtgcatgcctgtaatcccagttacttggaaggctgaggcaggagaatcatttgaacccaggaggcagaggctgcagtgagcctagactgcaccactgcactctagcctgggtgacagagaaaacaatggacaaagagattagccagcaaatccctcctgcacactttcagggcaaagtttaggtgatataaatgtccctgaaatgagaaaaaccatgactttcatttgattttaatgtgagggagaaacataaactagtagttttacaaaaagaaaaagaaatataatattcaagtagatttcaagcaacagcagatatgctgaatttatttgataactgtcttctttttctctgtcagcagagtctcatgcaattttaaaaggaaattcgatgaaacgaacacccatcaacatctttaatagctgcaagcaatgtggagcaaattttttgtcttatttaatgtggtcatcaccataacccagtaaagacaatatcatcattgctcccattttgtagacagggaaactgaatccaggataaataatgtagcttgcatgacaccaatcttcctcaagtctgagccagaatttatatctcccatttctcaacctcatctctcaagcctataatctttcagttataagaagggaaacacttgagggtgtatcagtttgtgttttgttcatagtgtttatatgctctcaatcaaggactgtttattaaaaaattttaggaggtggtagtcaaaaagtgtctctggctgcagtactggggacagactgcaggggtgagttcagcgagtctagttcagaggctgtggatcaaacaggtggggtggcccagaccaggagagtagccaaaaggggactaaggaagggaggccaaagggaggccacaaacgcaggagaggatgaaggtgctgaagctagaggccattcaggaaggaaggaatgacggggcaaggggtcagaaatttctagaagaatctagtaagatggaaacctaacagtcctactgggatttggcaactgggaggaagctggctctgtgcaggaaagaagggggcaccgctgtgcggacgccagactgcgaagggctgcagaaggagccgaaaggggaagaaacggacgcaggtaggggtggctgctgttaaagccgcttcccggggaggccaaggacatccacagctgaagtgctcaggaccatccacagctgaagtgctcagacactgcgttttctttatctcagagaggctgtgtgacttgcccacgtatgagtacagtggctaaatcacaagccctggagtcaagggtttaggttgatccagcccccactactcactggtggctgtcagcaagctactcgctgtgcctcagtttccccatctatcaagtagacagcactgccttacagatggttgtggggatcagaggggaggggacagctggcggatttagcagagtacgtggcacagaggaaacactaaatatgcttcttcagctccttatcaaggttaggcctccacaaagggtggagcagggaagagaaggcctcaccgggcagacctatcttggagaagatacaagcaatggtgctgaagtttcacaacagtgtcaaccccctccctcatgtgtgtactcacagctactcactttcctactctgtgccagccatgaggtgtagtcactgtgccagggggctgagtgtccggcctgggacgtgagagggcatgggctcacctgctcagggtttgaatgagaccccggtaaccgcagcagtaaagacccctcaaatgccatctctaaattaaaatgggtgatcagaaaatagcaggtgaacgatagtgccctcactgcccacagaagtgccttcagtcagatttagcgctccatcttctgcctttctgaagggacagtggaagcatccatttgaagactcttcctgtgtcttctgcaaaaccaaagaaaagccatcactgccgatgtctctctttaaagatctgttaggctaggcacggtggcttatgcctgtcatgccagcactttgggaggccaaggcagggggattgcttgaggccaggagtttgggaccagcctgggcaacatggtgagactccatccctagaaacaattaaaaacaaacaaacaaacaaacaaacaaaagcaagctgggcatggtggctcacacctgtagttccagctactcaggaggctgaggcaggattgtttgagcccaggaggtcaaggctggagtgagctgtgattctaccactgcactccagcctgggcaacagagtgagaccctgtctctacataaatcagtaagatccatctgtgcaattccttcctcctagaattcagaatctgaggtgctggtttcctgaggacacttgtgacttgctgccttttattgaactctgagtgccctattgcccagtttgagtgttccaatgggaagtgcagagccaccgtggccattcattgctgtagagctgcgccccagtacctgatacatccctcacccttttccaattgatttttagcttccttcatccctccctctttcccttgtcctcttcgtgtccacaggaagcctgttgggagcctgctatggcaagtgctgtgctaggacacggtcctgcactcttagagtttgtggttcagttattccagtttcagcacttacattcattcaaatgctttgtggaagcaagctggcttttagtcaccagcaatagcaatttctgaaaatcaccaagccacaccaaatatatgaaatatctttctctaaggtggtctttaaaatttgggctgactctcctccctctaggaatgttctgatgagtttcagtctgaaggcagggagatggtctcggtgacctcctgggcccctgttctgcactgaactgtatgcccatacattcataggttgagatcgtaacactccagtacctcagaatgttactgcattggtagaaaggctttttaaaaaagggaatcaaggtaaaacgaggccattagggtgagccctaatccaatatggctggtgtcctcacaggaagagtgtattaagatacagacatacacaaggaaaaccacgtgaagatatggagaaggtggttgtctgcaagccaaggagagagtcctcaggagaaaccaaccctgccagccccttgatcttagacttctggcctccagaattgtgagaaaatacatttccattgtttaagtcccccagtccgtggtactttgttatggcagccggaaggagactggggccgcctgtttgcttggctgcagaagccccacgtggctgcaccctggctcattctgttttctgtagcagcagcagcagcagcagcggcagcagggagcccaggatgcaaagcttggtttctgagccctgatcaggaggctgtgtttatatttatcctgctaactgcaggggactgtttattcccagagaaataacctcctgggcaggataggggcagccaaggaaccagctgcttccatcaggcctgctgggctcctccaggttctcatcataccacttctgtcgaggctctctctgacgcagctctcctcactccacaccaggcttgggcccaggggcacagcctggtcttcctgaggatgctcagacgcagggaccgactgctcctcacaagcaccctggcacatgcacagcccagggactggagccttcgcaaacaagtcacagtcctagtctgagattcagtgcaacactaggcgcttagtagatgctcagtaaacagaacaacaaggattttcttttttagttttaaaacattagtctacccatgccttgataaactgtaaaatgcctctgccacccattctcccttcttgctccctttcatgggagctctgaggggaaggtctctggggtgggttccagcaaccctgggcctgttctggggtcctgcagccaggttgggctttcaggagcctatatttcatctgggccccagtcacactacatagatttttgttttatcacagaaatcactgccacactgtgacccttaaggtcctcagcagggatggcgcgaggtgagagtatcaaagccaggtgagagcactcagatggcttctgcctttgaacgtgtgagaagctcactcatgcacagcgacaagcaagaaagacatgggaaactgacaggttttcatcactggctagtgaaaacacattttatacttctgggccaacaaatacttgggtcaattcacacattggcttgagaatgagttctttttctttttctttatttatttagagatggggtctcactgtgttgccaagcctggagtgcagtggctactcacaggcacaatcataacgcgctacagcctcaaacctctgagctcaagagatcctcccacctcagcctccgagtagctgggactgtaggtgtgcactactgtgcttggccaacgtgttcttttttgaggtgggaactttaatttacttgagcagatgtatcaacgtagctgtgaataaggagctaccagggcattagactgcagactctgacacaaccaccgtcaccacaataaatagcaacaaccaccaccacaacaagcacagacacctacatttttttttttttttttagctttgattactacactgtgttgctttcctcactgaggcttatgtggggttttctggttttaggaatcattttcacacacggtttatttacatttcttcacaaccacctagtgaggtaagcattatcctcggtttttagatgcacaatctgaggctcagaaaagtgcagtgtgaggtcactttgtgaataagtcatagaggtaatgtcagaatttgggtcagagactccacaagggctgaccctccttgcggttctctgaagacactgtagaaacccgtgggaagctctgctgtattgctgggtgctcctgttctgtggcaagacaacctagaaggtgatagggggtcttctccgagacatgtgctctgctggctctttggcagaaagggcagagtcggggatcaggacggtcatgcaggctggcactgcccaggggctgatcttccaggagctgggctagcaagctcgggatgggggatgggtcattccctccttctccccactgtcactataattctggagatctgtaaaaggatgtttaacatgtttaaagtctttgtttcccatccttctgccaaggattgagacatcgcccacccagcttcaatcctcatagctacttctgccactgatgggaggaggattgaggttctttctaccaaggagccaggaggatggctgtcactgctcctggaagcagggactcccagatgtggggataagtacgcagggcctgccttccctccactcttggtggcttccaaaggccaacattctagaaagccaaccacccatgtctcctctctttctattggagtgactctgctgcttcaacagagtattaaaaacaaagacagccttccaccctgacgtcagacacacagacacacgagcacgagcatcttgtactaccctgtgcccccattccccatcagcatacacgtggtgtttcggggataaagctacaccaaaggaaccctcccatacaggcttggtacagtctcagcctgtaacgcttccctttcgaagagctgtccctccagcaaggcctcataacccagggaacccctggcatctctgccgagggcataaaccatattagctctgaatcataaagaatgtttactgagaaccacatttgggaagacctttctctttcaaaccctttcttcccaggcccccagtgatggctaacaccattgttcgcagcgttcctactgaaacacattggtcgtgtgtactttcttgtctaactcatagattgcaaaagctataatttcatgggatttgttttaagcgcccttttctggcagatgtaggctcagtatgagcactctgtaattttccagcctcctaaatggccccctggcagcttacataccacatggtgtaacccacccttttcctatcctgcagacaacccaattactcacacagtcttcaccagggccctcctaggtgggtcccccaggctaggtcctgtgggggatgcagttgcacttataacaaaccatggcacatcctttctgaggaatactatgcatccaacaagagggatgcttagaaagttgattctgacatcacataccaatacacaaaaacaaaacccaaaattcatccagaaaatagactcaaggacaaaaaaatccctggagtactattttagtggtgaagctaaaggctttttttccctgtcactttttttgagcttctctctttttcaaatgttctataagaagtatctgttattcgagtgaattaaagaccactcgttttgtcattatttttaaaggcagagtctcaccgtctgggtggggagggaagtcatacacaagagaggagatggcaaggtgctaggaggttagatcatcactggcagaaggcaaatgaaggaggaggctccatgaagcctggatgatgaaggtgggctctgaagagggagtgggccttagatacatgaagggtaaaggacaggcagggatgctccaggcagggagaatgctatgaatgaagactggagggacagttcagggtcttgctgactagtttggctggaggaaaggctgcagtgagggtagcattagccacacttgggcttggaaaggctggggaccactgaaatgcaaagtagcttcccctgaaagaaaccagggaggctgctgtcagagagtggaccctttgggaagcctggatacagatggatgtcttttcccaattcagtcatttataagtagctcatatgtctctcaattcctcatcattttcgcagcaccaactttgtgggggagtagggggactagctgtggagtcagggacacctgggctagaatctcagctctgtcacttgctggctctttgatctgagaaagccattgagcctctttttgcctcaatttcctcatctgtaaatgagatgtgagctgtgctcacctccacaggatgctgatgaggattaaatgagaagaagtgtgtaaaatgctcagcatagtgctaatagcatgaccacctcaaaatgcaagccatttgtgctaactgatggacagcaaggaacagaatttctaaagagagtagataagaaaaaaatagagaagaggaggtcatggaatataaagccgagactgaattgcacttaacttcttttttttttttttctcaaataatttgctcagggctggggcagccagtatcatctacatgctctctccctcagggaggaacccatccaacactaaacttccagagaaagaggcaactatggacagggaaaagctgtaaatgaagcaagtgtcataagttcttcagtaacaccctctctcttattcaaaaacttccagtggcttcctagggtctagaactgtgagtcccaatgatcaggcttggaatcctttgggaactctgcagttattgcaaaggcatatcaatctacttggtcaccaattgttgtttgcaaccttaactttctcctacatggttatgctattactttccaaaaatatgtaaatggttttctgatgaagatgcacttaaaagtgctactgaattaattcagaggactttgtgtgtcaatatgcattttccctattaattaacggatactgaaagtacatgtaacttccatcatacaggtgctgtgaaactattcctcgcatttaaagcgattctcatgtttaaaaagttggaagcagcctaagcaaaatggcaaagccccatctctacaaaaactacaaaaattagacaggtgtggtagcgagcacctatagtcccagatactggggaggctgaggtgggaggatcttttgagccagggaggttgaggctgcagtaagctgtgatcatgccactgcactccagcctgggtgacagagagagactctcagtgtcaaaaaaatagttgggagacttctggttcaagatgattatttaattacctcaatttacctactctccctcttaagatcctatttaaatgatggtaaaaggacataaaggtgtaaactagcaataacacagggaatgggcagagggtttacagtggaagggcccgagaagtttcaacatgcttgtgcaagatggacagcttgagagagctgtaactgatgaaggcaggtggagaaacccacagctcagagggagtacagctgagaaggggagggagggaggggaactgccctgaagaaccctggagagacttgggtgtgggaaaggccatatagataatgggtagctgcccaccctctgccccaaaaagaaagcccgcagtccacaagccccacctatgcacactgagtttccagtccaattttctatttttaattcttaaatgtgagtggacagccacagttcagacatttgaggaaagcctgtaagccctctcttgcagctcctcctagcttagcctccttcatcttcaagggcactgcggctcaatcttcagatctcttcttttctggctcccacgaacacgccctgggactctgtggttctaaccttgacagcaactgaaattactctcatgaggagttttacaaaatgctaattcataagcccccacttccagagagaatgatacagttggttagggcacaacctgggcatcaaggcttaaaaactcccaggtaattttaatatgcagccagggttgagaaccactctcctaggtgatcttttctttttctttttgcgtctgggtctggctctattgcccaggctggagtgcaatggcacgatcatagctcactgcatccttgaattcctggcctcaagtgatcctcccacctcagcttccagagccccctagctgacattggcagggctttatttatttatttatttacttttgagatggagtctcattctgtcacccaggctggagtgcagtaccatgatcttgactcacagcaacctctgcctccctgtttcaagcgagtctcctgcctcagcctcccaaatagctgggattagaggcatctgccaccatacttggcgaatttttatatttttagtagagagggggtttcaccgtgttggccaggctggtctcgaactcctaccacatataagtggttctcactcctggctacatattagagttgatatggtttggatttgtgtccctgcccaaatctcatgttgaattataatccccaatgttggaggaggggcgtggtgggaagtgattggaacatgggggtggatttcccccttgccgttctcatgatagtaagttctcatgagatctggttgtttaaaagtgtgtagcaccttcccctttgctctcttcctcctgctccagccatgaaggacgtgtctgcttcctctttgccttctgacatgattgtaagttccctgaggcctctcctgccaagcttcctgtagcttgcagaaccgtaagccaattaatcttcttttctttataaattacccactctcaggtatcttcttcagtgatgataacattgctttagccagggttaagaaccagtggtctataggctggcaaatcccaaatttgtatctcaaacccaacctgtcccttgagttctagactggcctatccactatctaactggcacccggcttggaagtggaaaagtcatttcagaattaacatttccaaaaccaagctcttgattctccctcccaaccagcccctccttgattccacttcagccttccctatctcagtaaatggcaaatccatccttgcagttgctaagggcaaaagtcttagagcccttttttattcttttgctttctctcacaccctacatctgatccaggaacaaatcgtgccaccctactgtcaacacttatccagattctacacactgactttcgcttcaggccacgagggcgtagctgaatccagacttccctcccaccataatcaaccaggaaaccggaaaaagtctatgagataattattttcagacattggaaaaaaggtagttcaggattatggtccctgagagaagggaaacaaacaaggtgagcccttcaaaagccctggtttttgcctggtggcagctttcagacagccatgggagtggagagatccagacagagcccagaactcttgctgaattgaggggagagaaattcaggttcagggaggataaagcagctgtcactgcttaactgctgtaactactgtggagcactggagaggaaggaaccatcaagaaaaaggactccagaaatctactaggggtccctctttgttactcgcaaaggtctgaataacaatctgtgcaggtacagggtaaaacctagaaaaaaataagaccaaggaaaacaacttccaggaaatcacaatttccagagagctgtaaaccaaacaatttccagagccctcacaaagccaggaatcacctgagttcctatcagtcaaaggaggaaaggtttcactgaatccacaaggcattcagtagagaccccaaaaaggttattctttaatagtgtggctcatctagtcccagagaaaagactcctttagacctgcctttaaaaagcttaaaaacaagtctggaaaatatcaactgatctataaagaactgtctggcagaacaaagtccaaccctgcttgaaagagtacaaaacaatcaagcatcaacaatgtaaaattcatgatgttctgatctctaataaaaaatcagatatgcaaagaagcaggaagatgtgacccagaaataagagaaaaatagtcaatagaaacagacccagaaatgccagagattatggaattagcaaaggcatttaaatacctgttaaaatatgtaaaatatgctcaagatttaaaggagaaacataatgatgagaaaaatgggaaaaatttttttaaaaccaagtagaatatctcgagatgaaaaatatagggggctgggtgcggtggctcacgcctgtaatcccagcactttgggaggccaagatgggcggatcacgaggtcaggagttcgagaccagcctggccaaaatggtgaaaccccgtctctactaaaaatacaaaaattagccaggcgcagtggcgggcgcctgtaattctagctactcaggaggctgaggcaggagaattgcttgaacccaggaggcagaggttgcagtgagctgagatcgcaccactgcactccagcctgggtgactgagcaagactccacctcgaaaaaaaaaaaaaggaaaaatatcatgtctgaaatgaaaaattcactgaatagagttaacaacatactaaagactgctgaaaaaggttgaacttgaagacatagcaatagaactattcaaaataaagcactgtaaccaaaaaaagactgaaaagagcctcagctacctgcagaacaatgtaaattaagactaacatatgtgcagttggagttcaaaaagagaggatagggtagcaaaaataatatttgaagcaataatgtcaatctttccaaatttgagaaaatttataaacacgcagatccaaggagctctataaacacaaaggaaactacacaaaggcacatcaaaatcaacttgttgaaagtcaggaatgaagagaaatcttaacagcagccaaagaaaggaggcacaattacttacagatagagaaaaatattcacagacttttttttttttttttttttttgagatggagtcttgctctgtcacccaggctggagtgcagtggcatgatcttggctctctgcaacctctgcctcccgggttcaagtgattctcctgcctcagcctcccgagtagctgggattacaagcgtgtcccaccatgcccggctaatttttgtacttttagtagagacagggtttcaccatgctggccaggctggtctcaaactcctgacctcaagtgacccacccgcctcggcctcccaaagtgttgggattacaggtgtgagccaccacacctggccacagacgtcttatcagaaactatgcaagccagaaaacaatctttaaggtgctaaaagaaacaggaaaacaaaacaatgaaaaaaaccccacacttcagtaaatatgcatttcttttctgaaagatataatcacttctcactgcctccaccaaacatgccccggtccaaatcatcatcatctctcacctggaatatttcaaaagcctgctaatgagtccccacacttctatatttcccccgtacagttttttttgaacagcaatgagtggtcttagaaatcagatcatgttatgcctcttttgtctccctgctttttttaacctaagttttgcctcaggatctaatcatgcttcttctcaaaatcctcccgtggctccccatttcactcagagtaaaacccaaaggtcttgccgtggcctggagaccctgcatgacctagtctctggctactgctctgagctcacattctaactcccacttgcccctcctccaaacactattccagacacactggcttccttgcggctcctccagcaaaccctgcaagctcctcctaagggaccctggcactggctggagccctcttcctccaggcagccacatggctcactcccttacctcattccaagcctccactcaggggtcacatcatccaagagaccctttcagaccaccctacttccatcactttattcttaccctggttttgttctttttgcagcatttaccaccacctgacatttatttgtatgtttattttctatctcccccaactagaatgttagctccataagctagggactttgtctacttgttcactgctgtatccctggggattttcagttgctggcacatagtggagcgctcaagaaatatttgttgaataaatggatcaatgggaatcatgttttctggatgccaaattagaatacagggcctgctaactgttctggaaagtatgacgtgtgaaatcagtattaccccctaccccacacggcaccatatttttctggagctctccagttctagactcgttgacacataaaaatattttggtgctagtcctggggaaggcagattattggtttaagattcagttctagccacaggctgcactgtgcataaatctaggggactacatggagttctgaatgacatgtgtctcactacagtggcattacagagaaagcctggaaacattacaagggagtagagccagggccttgtagatactggctcattcaatcctgcaacccagaggagctgggcctcctcctgaagggcctgcatcacctccttccttcttgtttggccctggggacgaccggtggtggggaggtggggggaaggtcaggaactgagatagaatttatcagcgtgctggctccgagtctgcagctaggatgccctttagccacaaacagctataaaagaataagctttatggaaaaacattaaaaaagaaataaagcaagaatgtagatggaagtgaaggggactctagggacaaaaatgctatgaattaaggtcattgccacacaccaacctctgctgcacccccgcctccaccaatggtagtgcctttcccacctgcagggcacagggggctgccctcagcaatctccgagcagtgaggggagggctgccctgctgagcccagctttggaggaggggtatcctcctccagcctcagcctgcttcattccccacttcctttgtggctgcagcatcttcaactgccttccccccattatgagacatgcccacaaatctccagatgcattgttagaaaccctggggccctgtagagcctggcggctcatgcctgtaatcccaacactttgggaggctaaagtggacagattacttgagtccaggagttcgagaccatcctggccaacatggtgaaaccccatctctactaaaaatacaaaaattagctgggcatggtggtgcatgtctgtaatcccagctactcaggaggctgaggcacaagaaccacttgaacccaggaggcagaggttgcagtgagcagggatcgcaccactccactccagcctggatgacagagtgagactctggctccaaaaaaaagaaaaaaaaaggaaagaaatccccaggcccacggtcagcccctttgcctagatcttcctgtgtgggcatgatgtcaagaaatgaggggggaatggagagcaagaagacccaagatcagcagaggtcttgttgagtcttgttgagtgccgataaccaaattctgtctttggctcctgaaaatatctcttaccccttttcttttgctcctttccaaaggccacatgatcccccagttcctatccctagtcccctctacccaattcatcctgccacaaatattcagcatcctgggctgccatataaacaaatgaacaaacatttactggttctcaggctatgcaagggtcctccccatgaccctgtgaggtagacctcattgcaagagtatatagctcttcagtccaatgtgacgaattctgctctttgtttaaagtgtgaacaccagtagctataaaataaaattataacgcatagattatgaaccacttagagcgcgtaaagaaacaagtcatgttggcagtcctcttgaataagtttggaatcatatagcagttcagagctgaatatacaaactaagcacatattcctcagtgatttatcactgatagagatatataagctgttttttttggtggggtgggggggcacccaggatctcactctgtcacccaggcagaagtacagtggtaagctcttgataaagtgaggggacagttgataatggcctgatttaatgtttgaggtgaacagccaaaacaagggacttcacaattatctggttgtttgaaggtagttctagagactaacagtttagactaacgaggttgcctgacttaacggcataactatatagtgactaaagtgccagaatcttcttctaaaatagtcatgatcacattacacccctgttcaagaactccagtggtttcctgttgcccccataccaagtttaaatgtttccacctggctttcaaagccctccaatatgaccttaacctattgaagcagtttcacctgtcattgttccttaacttgcttaaggcaggctggtcctgacctcactcacactgttctttcaaacctgcctaccctgcaacctgagaggtggcatcagacatactggaaagaacaaaagatctggggtcagagaactcagctcagggtttagctttgccacttacatgtgaactcagccagattatctattaataaaaatataagcccacattaaagtgcttatgaaataccagggccagactaagtacctgcattcattgtctcatataattctcccaaccaccacatgatacaggtgttattatgattcccattttataaatgttaaaatggaagctttggaagttcatctattcaacaaacacaaggtactgtgctaggcaatgggaatataatagtggacaagagagacaagaaccctgttctcatggagcagggagtgagcagaggtcagggaacaaacaaacacataaacacgttatttgctcatgaacaggatgatttccaaaaacggtacatgttctaaggacaataaggcagaatagtgtgagggacagtgactaggggttagtgggggacactactgtaatcagggggaccagggaaggctcctcaagggtgacattttagctttagatatgaggcttgaatgtggttaagagaagtcagccatgccgtgactcacagagcagtgcgccaggcagcaggaacagcaagtgttaagtgcccagaagtctgatctgggtaagtccagcgtggctgtagtgcattgagtgaaggggaaagcagtgccagtgaggctaagaggggtcagggccaaattatgcagggccttgagtgtcatggtgaagagtcagattttttgcaacaggaagtcactgaaggatttcaaacaagcaaaggacttggcctgacttccgcttttaaagatctctttggctgtgtgtgaagaacaggctgtcaaggagcatagagaaagctgggggattggttagaacgctaacttagttgccccagcaagaaatgatggtgacagctggagtagactggtcgtgatgggcagcgagacaagtggatggaatcagaatgtattatgcggattgagctgacaagagttgatgatgaattggatatgaaagtttaggaaaaaaagaggaatcaggacaactctttatatggatgacatttattgatatgaagactcatggagcagtgtaccaaggagcaggaacagcttgtgaggggaacagtcaagagtgggatatagcaggaatcaggagttctattttgggcttttaaaagttttgatacatattgaatatccatgtggagatgtcaagtgggcagttggacccatggttctgaagcttagtgtagaagatgggttattcatcaatagataaatgggtttaaagccaaagggtgtgagggggatcagagtatgccatccccaaatatgtcactttagcacaaggattgttttgagctgcaggcaatttggaagcagcagatgcaaagaaagctccttatcctcccctatctgcctaaaggcaggacataaatttccctttgccaaggtgtcctccttaccctctctgtactcttaatcactggggaccccactgtcactctagagattttacaagattgagtctgcataacaaaccttactaaaaccaaagcttattctccattagtttccctcctatatttatcttcccataatttaccacttctagaagtccaaactccttttatctcatcattacttcacaatttatcactctttgttaaaatggtatacaacttctttttaggtaattccttttctatgaaggcctccatatgtatatgcaataaatcttttctcctattaatctgtcttttaattcagggccctagcggctgaaaataagaaaatgtaggggaaaagcttttcctctacaggtgagagattgtttggagacagtccagagtgaggactgagcatggggccctctcatactgaaaggtcacatagagatccagcaaaaaggaccaaggaaagcagccagtgaggatcaaggacagcatgatgttctggaagccaagagaaaagaggagtttgaggataaatggtcagccatgtcaaatgttgctgagatgctgaggacaggcaagtcatcactggatttttttaggaagggggccactagggaccttacaataacgtagtcactggaaaggtggggctggactcctgattgaggtggatccaggggagaagggcaggtgagggagaggttgactactcttctcagaagctttcctgtaaaggagggcagagaaatgggaaagtagcaggagggtgatgcagggtctattaagaaggaagaatatacatgtttgcataccgatggagtataaattaacaatgcatggggagtgggtaatgacaggaactaagccctggaggaagttagaggaagtgagacccagtgaagctggcatttgtaagtgggcacttcatccactgccacaggagagaaagcagctccacatggtgggtggatttaggggtgtgaagattacttctgattacttttattacctcaatggagtgtgaaagaaaggtagttagcagagagtgaggggaatgggaggctaaagatggaagagggaggataagtggtggacacagtaggaagtacagtgggatgtggggggtgctgccagtgtggagtgtccagctggtactcagggtcaccaatttaaagttggaccagtcagcatctctgcatagtttgttagccatattcagctgcttgagggcagatgaagaatacgtgggaagttggtattttgataggggtacaacatagggagagaggggcaaggaagttaagggtctctgaaaagggaatgaatccaagctgagttaaaaaagaaatgcaggctcaaagaagatggtggaaaaataagagtgggagtgtaaaggacctgtaggtcttacagccaaaggattatgatctcacccaaacagggtgatatcagaggatgggagctggaagcatgggaggtggtggtcagaggtgagatgtttagagtcaaaaactttgaaggtaatgcagttactagtaatagcaaggacatacatagatagaaccaaatgacctgctggggtgggatggaaagaaatatggttatagatgagatggttaaggagcccagttcttggatgcatcatctgtgggaggctggagaaggctggagaggaactcagtgaggcagacttcagtgaatgggcaggagatgcatgctggcaaccccaatgacagagcttgctatggtttgaatgtctcctccaaaacttacgttgaaatccaatggctattgtaagacttttaagaggtgagaactttaagaggtgattggatcatgtgggttctgttctcatgaatggattaatgtcatcatcactggagtgggttggttattgcgggagtgggctcctgataaaaggatgagtttgggctgattctgtcctgcacttgctcaccatgtgatgccttccacatggatgactcttgccagatgccagagccctctatcataaacttcccagcctccagaatggtgagtgaaatcaacttttttttgtttgtttttttttaataaattacccagtctgtgatattctgttatggaagcagaaaacagaccaagacaagctaaaattcatacccaagaccagggcccccagcattctctccctaaccactacattgtactgcaaattgtcacttggcaatgcagatttcttcattcttaaaatggatacatgaataatgcatacctgcccggctgaacaatgcacatcaaggagctttgtaaggcaatttccgtatgttaggcatacaatccaatctctgcttgactgcaccaagaggcccgaacaactccaatcagtacaggtgtatgacccacttcagctcttgttatatactctgctgaactgccttctgggtcatgtatattgctcactaatttgatgttaggaactgagatgccttagggattcggggactgtgaaggtagaaacggcagtaaggtggacttcatgcagctgctgggttcctgacattggttacaagttacatctctctttaaatataatggggtatgttgctgcttacaggagctttggaatgaatccctttgagaagcaaagccttcttttacaaagcaggtcatcatctgatcatcatattttactttttataaaacaggtgcctaggtagagttgggaatcttggaaacggccattcattcaaatttacattgattctgaaaatatttctgtagcccctcccatgtgccatgccctgtgccaggcactggagacatggaggggaatggaggagatagcgttctcatcttccaggaacccagaatctggcaagagaagcagatgctaagcacacagtcacacaagtgattccatgccaaaccagcaggaagtgtggggagtgacaaagagggtgctggcaggggcaggccctgcagtcccacttctgcactgacacaggcaaggacctcttccctgcctgccactgaggctgccagaccttcagaattagctcccatgcaatctcagctttctttcccgaccttccattttagaagagaacccagcaatccaaacctgcatggcctccaaaatgcaccccgcccctaggaaatgccaacacactcagcacaggcagaggcccgtgcctacctttccccctcgcacctgggctgtccctgcagaattcctggcaggtcctggtgttagcagctaaacaggctcacacgaggcgctcagaattcagaacacttggcagcagggaagaggatcatggccatttggaaaggattagagaggagtcacgcggagtgcgattcggagtttgcgtttatctcaactgaaactttccagaaagctaggacaactgattccaataaaagcttccccaagtatttttggaggcattgtgatggtgctgggccgtgtgggtgggggtggcttttcctggtttgtggaattgcatttcattactgattaaacttccgtcaaatgtgtgaagcaacctccagtttctaaggaatgtgtcctgggcaggtgaagagaaaaggcagaaccactggactgagaggtggaattgagcagggcctctttatggctaagagatgtggccaaggccagggccagataggaaatctgagtcagtgggaaaactaggaccagaagcccccctagttcagaactgaacttttcctactgctttctgagggtaacaagggctgaggcttagaattgtctagtttggtttcagtccagggcagggtcaggataaggacccagctgactcagagagccatggaaacgcactgccagggaggggagctccagaatgagctggctgccctgctgcacacctgccagccactgagagagcattaaagcaacggcccagcagaggggctcatgcacagccagcccctccagctgtaggagtggggagcccagcagggaggccctgggaggttctggaaacgtggtctgggcccagcttgctcagtttttattttttgttgttaatttccagcagtccagggttttcagttactcattcattccatccactcaacatatgttgattaatcacctactttgtgccaagtattatgctccatgattgacagaaattacctctttgctgcacttcgaagtagtcattcaatgcatagctgctgccatgatggttattatcatgttattaattgtaacagtgacaagcactactaagatgtagcttctgaggtggagaaagaagaaactacgttttctgcatacctactatgtgctgggccctgggccagctttagacacatcttaacccactgaacggtggcttacttcgcagatggggaagctggcatagaaacaaatgattggcacaggtctgagggcagtaagagggacttcacagtaggtccctctctagtggcaccatttgagctggatcttgaagactgatttcacctggtagaaaacagggaggaagggaagggcattccaggtggagagtacagcatatgtaacagcctagaggcttaaagtgcgaggtaagggggacagaagttaagggtggctagagaagagagtagcactggcaggcgcttggtgcaaggtctaggcagggtctgtttcaggacatgaccttaggcagagtctccctcaagccaaccacccttcaggaggcgagttctgagctggctatgtccccaggctttccttgctggtgtgcttaagggaggccctcctgtttttttggttttctgtcccgcctgtccatgcccactgcagctgtttccagtgcaaggctgagggttctcaggtctgggcgggagctcggtcctcttcaacaagttcccagagttctggtgagctctgtgggaagcacgtgctctaccctctccgatctggttggcagcctccttcacagagaggtactaggtggcgaaggatgggaagcaggcagccctcgctttagtgtagccactgacactgccagaagcacagcacagccaaatcccagagtccccaaactgtgcttcagctctcactgatgcctcctcatcctcctcctccacccacacaaccctgcagaccccaggctgggctatggttcttccccctctgtggaactgcacaattcagagacagcagagatcttgagcagtcaggagccgtggatcctctattctgccattgactgacttgctgtgtgatgccaagaaagttgcttaacctctctgagcctgtcatctgtgaaatgggatataattttctttgctgtcctaggatttttgggagcttactgagtaaacacagataaaaacacagtgaactggcaaacatgacatgtggcagggaggggagtcaatcagggagaccaacaatgcctcagttatccccctcactccccagaacaaaggcattggctgctggcatgatggagagtttggaaaggggagatactggtgggctctgtggcctcccctggccccagatcctgtcctgctccgggaggcttctgcctgggaagggggtcccggtgcttcctccacccaccagggagtcatggtagccctggggtgcagggagcagcagcctggcacccacacatggggctatttgctgcagtgccttccttcagcgaccttcacccagcagccatgacactggacccacctcagagaagtgtggcgggacctggcctcagccagcatctggcttccctgctactcttcaactccatgacctcctcctcagcctaagcactgccaagaggcctcagcacacctggaaacaaggagggtggccaggattgtggctgcccagggctctgctccgggtgtggggggcagagaagcactggatgtcactggtctaactcaccactcaatcattcattcagttatccaccaattacatccttgacaatgattaaagagcactgcgcctatgagggatgattaagatattctagttgaggacccaaagaaaatgcattttcaaaagtacccttccaggctggttatgtaacagcataggacacaacacacccgagaggcagtgaccaaccagagtgcagcaggtgccacacagcaggggggctgaggcccagaggactggaccatgcacagggtggtgtggccgggtgagctacagggaaggaaatgtgccttggcctcccctccttcacagagaggcagggcagggctcaccaacagggttgccgagatctggggagcagatgctactcatggttaccaggcactgcacccatgggttagagccttcagtctttaaagtaaccccatggggtaagaaccatcatggtcttcactttagagaggaggcaactgaggcaaggagaagtatatccactcaccagaaccacacagtttgaatacttaagaattaggacgtgaatccaggcaagcaggctggctgcagtgctggtgtgtttagagtcgacactaaactatactggaaggaaggatatgagccaatagtcttcccagatataagaacatctgagctaagaaggggctcaaaggaccttgggcattcccttcttttagtaagggagaaactgaggcactgaatggtgatatgtcctgcctaaagccacgcagccagttagtggcagagccaggtctagactcctagtgcctgactcaccgctgttctctctaccctagcgactccaagtgcatcagcataggcattgccaggagctcatgaggaatgcagactgtcaggtcccaccccagacctactcaacagaaactacttggtaagcagattcccaggtggttccaggcaccttacagtttgaaaagcactgctgcatgctatcctaccttcctggtctgtaacatctgttgctgttgagtataaagacactgtgaacattgtaaaatctgcaattacaagattctggatgcttcatcctgaggtcaccttggaatgagatcctctgggatctggaggaagcagatggaggagaaaccccagggctcaatttttctaagggcccaggcacaccagttaccactgacctgctagtaagccaggaacttagccccatgttgggggttggccaagcgcagggaggaggcagcactcacaagacagagtccggagcattctccaccacagccagtggccacttggagaggggacctagagtcccctggtaggtggctagggaatggcagggtttggggtagaacttcctggggccagagtctcatagcagtggtagccaagagttggcttagggtgagagccaaggggcttcagtacccttcttcattctctaccagcacctccccaacctcctggaaactgctgtgcttcctgcagtttcaagcccctccaccccctgttcctcaccaactctccccgtgtagaaactctgcagagagtatgaccgtgtctcttaaaaaaactttggtgaggatcagaggctggactctgcccaaagcacccaccttgggctccacacactttccggattgctggctggtggccccatgcagagcccccgaccccggaaagtcagtggaactggacggaaaaaatggaagggccagaaaacttggggaggactccagagctgggggtgacacaggaatagaccaacggccttttgttgtttccaagatcctctgaatctgaggcagccaaacaaggcatgggagtgctgctccaggtgtcagggatgggtacacttactgaacacttacccaaggctaccaccaccatctccagatcaagcaggagtttttacccaaagccccctcacaagtcactcagcctgccttctgctcctcagatacccacccttctctccagctcctcccctctgtgcgtagcgcaacactcaccccttctgggaagccttggtgccctctcagaactgtactggattctctacttgtctatgtgagcagtgtgtgtgtgtgtctgtgtgtgctgtttgtgtgagaattatgtgtgtaagaaagggtgtgggagagtgagagagatacacctacctttggcaatattgatgtaactcttctagggaggatgagagcgcaagctctcagggaatccccctttgacttgctgggtaacttgggcaacctctcctcctctctgagccttgtgtaaaatgaggaacaagggtaaattcacccgctttgggctggtcttggagatgctctagggctcttcagagaagacttcagggagcgggcggcaactgaggaaaggcccactggtccggactccagcccccacccctaattacagcagctctgctcctatttgctataatgggctgattgttggcttttgttgacaaaatggtctacatgcctggggaaagttatgaaggatctttgtggtgcttccagctagaatactctaggagtgtacctttgctccattcggcacaattctgagctgttcgacgcggaggcccttgggcatagtcaagactgagtggaaatatgttctctctcagctggcttggcccaggaatagcggcagaccattcctgggagtccaggggagagcagggggatccaggtacctttcttgtctcagtttttgatggcctggcagtgcccccacctgttttttcttcttacctttctccactctcccagaacttcccaaaggaagctgctctcattaaaacaagggaggttgaagatcctaacgccacaggcttgttcgggaggcagctcacctcctggaactgagtgcagtcctggagaaaaccaagtggatgtgcggcccctttccatggagcaattaggtggataactgtccagtcgctcctaggctttgtagaggcataggctcagatacaaagagaccagacagtctctcgctccaaaggggctggccacaagcaccatgaagacagc

SEQ ID NO: 36 - DNA, 229341 bp, Homo sapiens
aatcaccagattctgtttacctataaaatcacaaagaaagcctaagtatattttgggaatatacatatattttcatgtatttatatacaacatgtccttgaataacatcgttttcttctaacgttgatgagaaaaataatcaattcctggccagggccaccgtctgtgtggagtctgcatgcttttcccatgtctgcatggggtttctccaggtattccagtttccttccacatcccaaagacatgcacattattcttcttaaatgtatgtatagctcatatttacttcagtgttttctattagaagtgtttttggccttcatttagaagtttggtgatgtttttgtgaccagcaatatgccctaggaacttaactcttgtgtacatccagtagcctatggtaaaattggttttgctctacattgtttcacttaaagtcacagtttccaagaactcacagatgacattgaggacttatctatgtgcatagatatgatggacatcctgacatttagtggatctcctttaaaaaactgaacttaaaagtctcttcacgggcaggtcaatttcactggttgaaagtaagagacagctgaaccctcgtggagccattcatacaagtccctatttaaggaacaagtgattatgctacctttgcacggttagggtaccgcggccgttaaacatatgtcaccgggcaggggtgcctctaatactgataatgctagaggtgatgtttttggtaaacaggtggggtaaggtttgccgagttccttttactttttttaacctttccttgtgggcatgcctgtgttgggttaacagtgggggtaataatggcttgttggttggttgtagatattaggctgttaattgtcagtttaatattttggtctgatgtaggcttatgtggaggagaatgctttcatgttacttataccaacgttagttcttctataaggtaatagattggtccaattgggtgcaaggagttcagtcatatgtttgggatttttcggatgataggtgttgagcttgaacgctttcttaattggtggctgcttttaggcctactatgggtattaaattttttactctctttacaaggttttttcctagtgtccaaagagctgttcctctttggactaacagttaaatttacagggggatttggagggttctgtgggtaaatttaaagttgaactaagattctatcttggacaaccagctatcaccagactcggtaggtttgtcgcctctacctatgaatcttcccactattttgctacatagacgggtatgctcttttagctgttcttaggtagctcgtctggtttcgggggtcttagctttggttctctttgcaaagttatttctagttaattcattatgcagaaggtacaggggttagtccttgctatattatgcttggttataatttttcatctttcccttgcggtactatatctattgcgccggtttacaatttctatcgcctatactttatttgagtaaatggtttggttaaggttgtttggtagtaaggtggaatgggtttggggctaggtttagctcagagtggtcaagttgagttgaaatctcctaagtgtaagttgggtgctttatgttaagctacactctggttcgtccaagtgcactttccagtacacttaccatgttacgacttatctcctctatataaatgcgcaggggttttagttaaatgtcctttgaagtatacttgaggagggtgacgggcggtgtgtacgcgcttcagggccctgttcaactacgcactctactcttagtttactgctaaatccaccttcgacccttaaatttcataagggttatcgtagttttctgaagtagaaaatgtagcccatttcttgccagctcatgggctacaccttgacctaacatctttacgtgggtacttgcgcttactttgcagccttcgtcagggtttgctgaagatggcggtatataggctgagcaagaggtggtgaggttgatcggggtttatcgattacagaacaggctcctctagagggatatgaagcaccgccaggtcctttgagttttaagctgtggctcgtagtgttctggcgagcagttttgttaatttaactgttgaagtttagggctaagcatagtggggtatctaatcccagtttgggtcttagctattgtgtgttcagatgcgttaaagccactttcgtagtttattttgtatcaactggagttttttacaactcaggtgaattttagctttattgaggggaattgatctaaaacactctttacgccggtttctattgacttgggttaatcgtgtgaccgcggtggctggcacgaacttgacgaaccctagggttagtatagcttagttaaactttcgtttattgctaaaggtttatcactgctgtctcccgtgggggtgtggctaggctaagcgttttgagctgcgttgctgcgtgcttgatacttgttccttttgatcgtggtgatttagagggtgactcaccggggcagggatgcttgcatgtgtaatcttactaagagctaataggctacgaccaaacctatttgtttatggggtggtatgagcctgtcgaaacattttcagtgtattgctttgaggaagtaagctacataaaccgtatggggtgtctttggggtttggttggttcggggtatggggctagcagcggtgtatatgttgagtaaggtgggcagggagttgcattgatggggttagtagaatgtgagttgagggaggatgatgtgttagttgaggggtgactgttaaaaatgcataccgccaaaagatgaaatttgaaatctggttaggctgatgttagggctctttgtttttggggtttggcagagatctcctttaaaaaactgaacttaaaagtcttaccaaaattcatacttatcactcattacctaaatctaactatttttccctttggcattatccaatttatatccaatatttagttttaatcatttgcaattgtgtatgacatagtaaagattctggggaggccaagatgggcagatcacgaggtcaggagatcgagaccatcctggctaacacggtgaaaccccgtctctactaaaaatacaaaaaattagccaggtgtggtggcaggcgtctgtagtcccagctactcaggaggctgaggcagaagaatggtgtgaacccgggaggcggagcttgcagtgagcggagatcgcgccactgcactccagcctgggcgacagagcaagactccctcttaaaaaaaaaaaaaaaaaagattctgagtcaaagtgctcaagttgaatgcattttgtcacccacaagacaaaacgtgttaaccccttgtggtttactttatctataaaatagagataacaatagttcctgcttctagggttgttgtgggaattaaagacttagaataatgttcagcctctaatcagtgctgtcacaactgtctgatacaattgtattatatttgtgtactttgtagattgatattaaatcatacttttaaaaataggtgcttaatgttccactcaattaccttaaaacatgtttaattatgtctctatcctactcttataacacttctataaaaactttttacatatagcgtccacttttggttcagtttcttaggaaaataactttgagagtcagctatctgaaccaaagaaacattaacattaccagactatattgggatttttgagactggcttttatcaattctttagctacgggctcttgtcatcatctctaccagtgacctaagtgtcaaacccaaatgccttgtatctgtcccattaaagagatgcagcatctgctcctttcttactgtttccatttcctctgccatgcctcctcttacaaccataaatatccaggtctcttaggttttaaacggggcatctctcaacccccacattcttttccttggttattcccttccctccaacagttcaattcacctagatccccacgcctgaaattatcctagatgtcctagaggcgcctcatcattacaatggtacattattctccactcctttacatgtcacgccagctttcaaactgaaaatctgagcgttcatccctggtgcatcacctttaaattcgagatctccaaaatccagggtcatgtaaccttaaaaaatttttaccctctcttctccactgcccttgttcaggccttatctcttccagcagctgttccaaaggcctactctgttttcctttcggagtgctcacctccaccgaagcctccacccagctgccaattctgccccatgcctgataatttgctcgtgcgttgacatacataaaatttctaagacaaaaattttttaataatggtaaatgaaccttgggaactgcatacagatcatacagatccataataagagaaaaggtcccagattaacacggaaaactttccatttaactaacatttgcactggtaaacttcatcaagcaagaccctacttaatcccacattaccttctactgaagaggttgtggtcattctctggaaatatctgaattcattcctacaagttagagaaacagcgttactcgaaacattatcccttgggctcgagctctaaggcacctgacaaacggagcgctgtgggtaggggtgaggtgttttctccagggctgggactttgccctgggcgagggcgccgcagggcaaagacctcaccgggcagcagaatccgggcagaaatcagcaactgggcctcccgcgcagcagaaaaggggaatccagtcgggcccacccttcctgccagcgcagaccgcaagtctggccccatcctctcgccgggagtcggccaccccgaccgtgggcagcctgcgcccgtttgggtcccatcgccccggcccggcagatacctgagcggtggccagggcaggtccccgttcttgccgatgcccatgttctgggacacagcgacgatgcagtttagcgaaccaaccatgacagcagcgggaggacctccgagcccgctcgttacagcagaacgcgcggtcaagtttggcgcgaaattgtggccgccccgcccccctcgtccccatttgtgcaggcgaggccccgcccccccgccccggcgcacgcagggtcgcggcgtgctcgcgcccgcagacgcctgggaactgcggccgcgggctcgcgctcctcgccaggccctgccgccgggctgccatccttgccctgccatgtctcgccggaagcctgcgtcgggcggcctcgctgcctccagctcagcccctgcgaggcaagcggttttgagccgattcttccagtctacgggaagcctgaaatccacctcctcctccacaggtgcagccgaccaggtggaccctggcgctgcagcggctgcagcggccgcagcggccgcagcgcccccagcgcccccagctcccgccttcccgccccagctgccgccgcacatagtaggttctgtctgggactgggcagggccatcggggctgggggggcggggcttgtgggtaaggcgggcggaggcggggaccctccgcccgatgatagggctggaggaggaaggggcgggctgaagaaggggaaggtgggaagagcccagccggggctacaaattgggtgaagcgctgaggttttagtacttccgtttgaggagataggcaaaggttatgcaggtttttaatggcaggcctgagacaggaactcaggtctcctgactcccattctgatgagggggcttgtgggcaaggggtgcgtcttttaacctccatcctttttttttttccttggtggtcgaagagttttactgattttttaaaaaagtgctggattgggtgactagaagaaagctgcccttaggtctccagtttttaagactgcaacagcatggctcaatatttgaaatcactacggttaaaagcagtcatattgtgcagttccccagtgaactctttttgtagtttagattataaagtctgaaatacagtttgggtggataaagtttcttaggatggtatagatgtgactaatcatggagtccttcctgttgccatccttcaacgcaataagtacgtttgtttgtttttaaaccagagatactgccacaggaaaagcccaagggtgacccctcacttgggtcacctgcacagtatttttcagattgaggctgtggaagggcattgaagactggtgtttagccacctaccgtgttttaatgtaggtggcagcttgggtgcttcaaaatcttgttcctttcgtatatatttctcccttaaaatgattactcctcttctgttttttttgaggacgagctacgttttcatgaattcaccaaaattttgcacccaccatttaaagggtagctggtgaaggacttatgtatgcttttggcaagttttctgccaagaaaaaattcataatcttgtcacatctttagtgatgaacataaaccttttaaacaggaaacacttaaattgcagtgaacatgtcaaaaatgatactgttcttttattacctatcttttcccctctgtgcctttgctacataactgtttatttcttagaggtattttatttagcatatgtaagtagggtgattcaagttttataattagagaaagctgaaggctcattgaatcaagaccggtagcagccttggtttcaattaattctaaacacggcttgagttgctgaggctcctgactatcagactctaccttgtcttttatggtgttaaaaacagttcacccatagggttttccagagctaaaagtagaggattctttgaagagtggatggcaaggaaccttgtcattcagttgtaaggtttaaattgcttcacatacgtcaggccttctcagagtagagataacacatcattttctaaccttcccgatataggctacagaaattgacagaagaaagaagagaccattggaaaatgatgggcctgttaaaaagaaagtaaagaaagtccaacaaaaggaaggaggaagtgatctgggaatgtctggcaactctggtgagttgtgggggattcttttttctcctcagtcatggctctggtattctggaattctccagagggcagaagagcgtattagaattgtgtcttttttctttgtggagaaaggtcccttttgttcctgagcagagtggccccctataggtgatggtgatgtgtataggaggttaaggggatggtagagctacaattctgcaatttagctgtagttctcccaactttctcctttattccttctagctatttttgtcctggttataaaattaaaacattcttgctacagaaatttcaaacagtacagaaatgtggaaggtaggcagtgatagaccccataatccctccctttgagtgaggcccactgctattggtgttctgtatatacttccagattttaaaaatttgtacatgtgtatatgtgcatagtcataagctcaaaaattagtttaaatatattttacagattatattatattctatactaatttgctactatctttttctacttaatagaaaattttgaacaattttcagtatcaggacctgcagatctactctccccgcttttttttgcttagagctgctctttgtgtatgtaaaaggcattgaataaaaacagcatgcctaggctgggcgcaggggctcacacctgtaatctcagcactttgggaggccaaggcaggtggatcacctgaggtcaggagtttaagaccagcctggccaacatggtgaaatcccatctccactaaaaatacaaaaattagttgggcgtgctggtagttgcctgtaatcccagctacttgggaggttgaggcaggagaatcacttgagcccaggaggcggaggttgcagtgagccaagattgtgccactgcactccaccctgggcaacaaagcgagactctgtctcaaaacaaaaaacaaacaaaaaacagcacaaaaataaataaaaacccagcctgcctgagtgcctgagttcctggatttctagaggtggtgttgcatatagacagttgagcagatttttctctagttttatggtaccagagaatttgtgataagggaagacaggaaatccatctttattcattatcctcaggaaattaggtaaagagaatgagaaaaaaaaaaagttccaattcagatagaggtatctgtccaatggagatatatgtaaaatattaatccttccataaaaggtaaaatttgaattttagggtcaacatgaaagtgttagtatgaaataactacaggaatggagatgtgtggctaaggagaaaagtaaatctaaaacttcacctttctggaggggtcatgcaaggaggcgtgacttgagagaatttgccacggttaatgttacaattctggggcagcctacctttcattgcttgattattctgcatagacccattttttaggtctacaaacactgaatgagcacctatgatttttattctagaggctttttgtagctcatttatttttcctaagaatgctttttgccctctttttttttttttgagatagggtctctcgctctgtcacccaggctggagtgcacttgtgcaatctcagctcactgtaacctcctgggttcaatctctgctcactgtaacctcctgggttcaagcaattctcctgcctcagcctcccgaatagctgggattacaggtgcgtgccaccacacctggctaatttttgtatttttagtagagtcagagttttgccatgttggctaggctggtctcaaactcctggcctcaagtgatctgcccgccttggcctcccaaagtgctgggattacaggcgtgagccactgcacccggcctgttgttctctttttatagaggaagaagtgggtgatagatgaagagaattgatgattatcacagttaagtaacttaactaagaccacatggggacagttgagatggaatgttgttgaaataagacaacacacttggcatattttaaaataggacctttgccacttgttaaaaatggcactaaggaagaagggggaggatcattcactagtcagaagctgggtgactgttccacttcagtttattttattttttagagacaggtcttactctgtcatccaggctggagtgtagtggcagggtcattgctcatgtagcctcaaactcctgggctcaagccatcctcctgccttagcttcctagtagcaaggaccacaggtgcatgccaccatgcctggctaattaaaaatatatatatttttttagagacagggttttgctgtgttgaccagattggtcttgaattcctggtcccaagccatcctcctgcctcagcccttcagtagctgggactgtgctcctgagccatcatacctggcaagttttttgtttttgtttttttctaataacagaattattaagatatagttcttggggccaggcacggtggctcacgcctgtaatcccagcactttgggaggccaaggcaggtgtatcacctgaggtcaggagttcgagaccagcctggcccacatggtgaaaccctgtctctgctaaaaatacaaaaattagccggatgtggtggcgggcgccagtggtcccagctactcaggaggctgaggcgggagaatcccttgagtctggaaggtggaggttgtagtgagccgagatcgtgccactgcactccaagctgggtgacagagtgagattctgtctcaaaaaaaaaaaaaaagatacagttatgcaatatgattcacccatttagcatgcacaattcggtggcttttaggatattcccagagttgtgcaaccatcatcaaagtcaattttagaacattttcatcaccccaaaagaaaccctgtgcccattaacagccacctcctgttctgccccagcactccccagccctaggtaaccactaatctactttctgtgtatagatttgcctattctgaacatttcatataaatggaatcatacaatatgtggcctttggtgtctggtttcttgcagttactgtaatgttttcaaggctcatccgtgttgtagcatgtatcagtacttcattcccttttctaaaaatattcattttctttattgtggtaaaatatacataacataaaatttatcatcctagacatttttaagtatacagcccaggggtatttagtacatttatattgttatgcacccaccaccaccatccatctccagaactcattttatcttgcattcctataactctgtacccattaaacactgactcactgtaacccccttcccccagcccctggcgcctaccattcagctttctgtctctatcattttggctactctataatgcattcattcctttttatttccaggcagtattccattgtatatatccacctcagttcttaactcttcaattaacaagttattttttatacctgggatccacgggggaaggaaacttttatactcacaagcaaacttagatacatttgaaaagccagttaagtacgtatttttgaaaaccaagggaataataataaagtaagagatgcatagtccattttcacactgctgataaagacataccagagactgggaagaaaaagaggtttaattggacttacagttccacatggctggggaggcctcagaaacattgtgggagttgaaaggcacttcttttttttttttttcttaatttaagttctgggatacatgtgtagaacatgcaggtttgttgaaaggcacttcttacatggcggtggcaagagaaaatgaggaagaaggaaaggtgggaacccctgataaacccatcagatttcatgagacttattcactatcatgggaatagcatgggaaagactggctcccatgattcctcccactgggtcctcccactgggttacctctcactgggtccctaccacaacacgtgggaattctgggagataaaattcaagttgatatttgggtcggggcacagtcaaactatatcacattggaaaagattcaaaaatatatttttagcataaaggaagtcatggtaaacaaggtaactgtatattggaaaagtcatatttagaagaaaagagtcactgtatttcttcggagattcttagcctttagcatataagacatcaaaggttttttatttttaattatagagggttgtctttttctctggttgcttttaagattttctcttaatcactgattttcatgtttgattttctttctgccccatataatctgcaggaacccatatttgattttggtggaccttgtctctttcccccacacccgagacagcctgtgctgtctagcacaggctggagtgcagtggcacaatctcagctgactgcaacctctgccccgccaagtttaagcaattctcctgcctcagcctctggagtagctgggattacaggcactcgccaccacgcctggttaatttttgtatttttaatagagatggggtttcaccatgttggccatgttggtcttgaactcctgacctcgtgatctacccgcctcggcctcccaaagtgctaggattacaggcatgagccaccgtgcccagctgcctttgtctggtttttaatttttatttcttcatttatttttatcctgtttagagctcatttaaagcttctcgagtctgtgggtttataggtcttattaaatgtgggaaacttttttggttgttattgtttcacattttttctgtcttcctgtctcttgtgtctccttctgagagtttattacggggatgttaactatttggtgttatctgttaagtcattgaggctctttccatttgttttccaggcttatttctctttgtacttcattgtggatagattctactgctctgttttcaagttcagtggtctttttttctgctatgtctaatctgctgtaaatctcgtttaataaaatgttcgttttccatattgtatgtttcatctccagaagttccattttgttcttttaaaatattttccagttctctatatgaattatatctcagtaaagctaaaaaaaattccttttgctcctctttttgctcatgttttcctttacattcttaattatatggagcatatttataaattgtattttcttgttcttatatgctaattgcatcatatctgtcatttctggggctgcatcccttgacagatttttcctattttttgcatgtctagtaactaattatttggatcatggatatgttgaatctgtgttgtctcctgctggagtttgtatttctttagagtgttggactctgttctggcaagcaattaaattcctttggatcactttggtctttttaaggattgtttttaaacttcggtagagaataatagcccttactctagagcaactttagtcacattctacggcttgacctttttagagttagaaagggggtgcatagtagcagtagcacaccattatatcgtatttccacaatacagagacagtagacattagtaacattaagaatgtaaacacagccatatgctacctaatgacagtcagtgagggaccacctatacaacattaatctcataagattataataggtatttttgctgtaccatttctatgtttaaatatgtttagatacacagatacttaccattgtgttacagttgtctctagtattcagtacagtaacatgctatacaggtttataacccgggagcaataaactataccatatagcctaggtgtgtaggaggctataccatcatctaggtttgtgtaagtacactctctgatgtgcacacaatgatgaaatcacctaatgacacattcttcataacatatccccatcattaaatgatgcaagactgtcaacacctgtagtaagttttaggcagtgagtatttattattcatctagtagcatctgccagacataagagtccctgattatttcatctctgtttttaacactttggttttaaatactgtcaaagtcaaataaaatatagggacaaatctctaaaacattttatttggggcggggcacggtggctcacgcctttaatcacagcactttgggaggcggaggcaggcggatcacctgagttcaggagttcgagaccagcctggccaacatgatgaaaccccgtctctactaaaaatacaaaaattagccagatatggtggcacacacctgtaatcccagctattcaggaggctgaagtaggagaattacttgaatccaggaggcagaggttgcagtgagccgagatcgcgccattgcactccagcctgggtgacagagtgagactctgtctcaaaaaaaaaaaaaattttatttgggaagcaagaattgcaatttgggacatacacacagaccaggtggtctttggtatgtttgaagcacaaagagaaaattggaggttttattaaaaaggagaaataagccaggagcagtggctcacatctgtattcctaacgctttgagaggccaaagcaggaagattatttgagcccaggagtcagagaccagcctaggcaacatagggagaccctgtctatacaaaaaattaaaaaaaaattagttggccatggtggcacttgcctgtagttccagctactcaggaggctgaggtgggaggatctcttgagcctgggaggtcaaggttggaaaaagaaaatgtattgttttgaacgaaggttcattggtacttggaaaatttggagtaactggcaagctctgattagtgaatgactgcaatgggtaaaactagccatagagtcacagcaggttgttttagcagctatcaggtaaaattggtttcaggttacagtaggcagtttcagcagctaggcttgcagagaattacatttttggagcaatgatatgtgctctcagtgctttttcccctggcctctctactccatttcaattgagtatgacaagaatgacccaatttatatgatcaactttcacaatactttttttttttttcccagcaaatacaactccaagatcttcatcccactttcattccaggcagtttttttttatgtctataggagggaaactctttgtataacatacacacttatagtatatttttgaagagcgatacaaatatacatttcaaaaaagagagtaatagtaaacaaggtgaatatacatttgagaaaagagtcaaatttaaatttttgtggctagaaaattcacaggagatctaatgaaagcctgtgaagaggtttaaatataaatagggaaaattttaaactattttttttgaagcaacaaaagcagagatttattggaaacaaaaagtacactccacagggtgggagtgggccctagcaagcagcttgggagcaattttaaacttttagaaatgaacaaaacacaactcttgccctcagagtgtttttgctttaatagggaaggtaagaggtgataaatgtgtgcagtcccagttcctttacatttaatagcaccaacctaatagtagtgctctaaacggtgaaatactgtgttctagtacatggtagggatccagaaaatgatagtttcccttcttttatggattgcttgtttatgaaaaactgccaattggcagactgtgatgagtgccacagggagatgtgatcttgttagaggaacacagagaaagaaaagatgattttaagctgtgaaaattagcagaaggttttatgggaaaggtagatttgagatgggtcttgaagaatgaatacaattttgacatgcagaaagcatatcatgggcaaagtgatggtgtttctgagtatggtgatttggttttcttggtaaacccctgatgtcaatatcaagtctttccgcttgagctagtaagatttcccagtcaagagtcctcccagcttctgcctggaggggagtaggagtgctctggcttcctgggttctggagaggccgtggatctcagcatacattgtgtctgtgttcctaatcgtccttctgggttaggtacagtactccatcaactgtgcttgttttgcctttccagggaagaaatctccagttggctgctgatgtggaggaaggacagttgtctttgagcttggagtatggtaggggtttagggaacaaattgctttgaaccaatcctctttattttagaacctccctttattcctttccagagctactggtactctaattcctgagtcttttgagcattttgtgttgtaattagagttggctcttggttttcctaattactgacttagtatttagctctcaggtgtgctgaattggttactgttcatttgttttcctttctagctttagatatctcatttgcagttgttacctctcctctctgtccttatgggcttatgtcttcaaaaaaaaacaaaaacaaaaaagaaaaaaaacctctactatagtaatgaggtttcaggaatgagtgaaattgcatctgtgtttaatatgccatctttaccctgaacccagtgtttctttctttttttaaaaaaatcacattatagttagattcattgctttattgggaatctacctctttaaaaaattctatgctggttatgaattgacataatgagaccaaaattactattgttctgttttcttcttatttgctgcctaagagccaaagaaatgtctgaggaccaggaatgtttcaaagtctctggaaaaattgaaagaattctgctgcgattctgcccttcctcaaagtagagtccagacagaatctctgcaggagagatttgcagttctgccaaaatgtactgattttgatgatatcagtcttctacacgcaaagaatgcagtttcttctgaagattcgaaacgtcaaattaatcaaaaggtatgtaactgctatagatgagtatccagttacctagaatagtgggttctgaagtactgtcaggttctctgaggtcattcatggcaatggttcctaaacttggatggtcttctgaatcatctgagggagcttttgtgttttagtttagttttcttacatccctggagattcgatttactgtgttttgggagggattaattggtttgtatgggaacaaaacaaaagccttccaggtaattctgaggtattgcctggatcaggagcccttgacttggagggattctttattgagaattaatacaagcacagtttcttacagtcttccttagagtttccatgattaccgtggaaaatcatgatgggcaacttagatattttgaggtttcagttgaaagcttgatagatagaaagtaaattcaaatgtaagccaaatgaacatgggctttttactttatccactatttgttttgagacttttaatggttttcataactgcagaatcagggaatttaactcatgctccatcattgaaatctgtaattcagaatagtgattggttcgcaaccttagctttacattggaatcacctggagaacttcaaacaaaaattgccattaagaaccttccctcagaatcttatctaattggttttcactgacaaatgggcatggatattttttaaaagtttacattttattttgtattttatttttattgatggagtcttgctctgttgtccaggctagagtacagttgtgcgattatagttcactgtagtctcaaacttctggtctcaagcaatcctcccaccttagcctgcagatgaggtgagactaaaggaaaagcagtcattttaatctgtagctgtgattgacaaccattgaattagagaaatggttctatatatgtatatgtatgtgtgtatgtatatatatgagtcattgaaattctaatgaaagctgttggcctttttcttcagaaaaattctcaagccaacaaaattttgcctataattttcaagatttcacacctttcccacaaagcccagatccatgaactcctccctcagccaggctaatattgattgacttatcttagatcatcaagaaaaaaaaggtgtttttgtttttagtctcttttaatacttagaagcagttcacctaagtatagtggttattaagcatagaagtcataaagtttatccattaaagctcactttattgataggagcatttactccaaggtctcagaagagcgtatacattattgctttatacatagaatgaccaacttggcatgtccacatcacaggaaattagaagtaagtagacagagggggcacgtagaagcagtgccattattacaggtgataagctgtttgatggcatggatagacgtggatgaatggcaaaaagctactgagtgaacataaatgccccatggtccaggaccattagggtggggtcagcaatgccataactctcaataggtttcgaaatatattctgatcactctgaattgtccagacaaggttaaattgagttcagcatactgtctctgggaatatgaaatagaatgtaatgtatctgatgagtatttctatccaaatcattttttttaaagttgcttattttgttacccaggtattaatatgtacaacaaaccctcatgacacaagttttcctatataacaaacctgcacatgtacccctgaacttaaaatgaaagttaaaaaaaagttgcttaatattcaagtatttagattgatttaattgttagcatcccataaggataaaacttttttttcctggaagcttatctcatttcctaaaagaataaagtataaagtaagaataagtttttacaatgtaagaaatatattttctgtgttgattaacttttatactacatagtatatacctgcatttaatatagaatacatactatattccatgacataaaagtcatggaaacaaaataggaaactcatcaaaattaaaagcaaaggcattcttaggtataggaaaattgttatgcaatccttggggtgttgcttcgccagctgtaaacctctgtggctggtggtgcctttgcccgagtttttacttgggcctgctgggctcattcctcccactcggcctggcaggctgtgcttggcttttgcttttggcctgaatctcgcagctgccaagggtgagccaggagtggagtggtgagggtgaggggtgtgtgagcaggtgaccatggggtctggcccctgtgcactgccaggcatgctggcttcggcagggtgggcagctccaggtgccagcgtgagtgagggctggaccaggcgtaccacaaacagcttccacagctggcaccagggaacacagtggcgcccagaagcttggagattccaggaactgcagagccccagagagggtgtcatagacctggcttaggagcccctaggtctgagctccccagaggtccacagctcttctctcctgtcttctctccttcttgttgctgcaatgtggcaagcaagagatgggtttcaggcctgtttgtgttacagctcttttagccctgccattcggtgggtcccaggttcttgtcctgcttccaggaagaatgaagtatgtggacgagtggagggtgagcaaggcaaagaggggcttccttgagtgacagaacattgaggggagacccgcagtgggtgcttctttctgcaggcagggcatcccatcaagtgagaagtgatgagccttcagccgagaggggaccctggagtgggtagctcctctccgcaggcaggttgtctgcttgtctcttcaagtttggccgagtctggggatttgtatgggcttgagaggaggaagtgtgtgctgattggttcatgggctgccatgggcgggctcagaaaacaccgtaagttctaattctggttcgtcagcctggcccccaggcttcaggctgttcctggcttgaaggtggggcttcacccggacctgaccctttctgctcaggagcctgtctgcctcctgccgtcatccatggcacccaggctgtttgtgccatggggcacctgcaggacagctctgagctgccctcagccctctccttggcctccttcccatgttcatcagtgtccaaagtccagagggggccgaggcagcagggggctggcatgttagcactgccctgagcatgtgcacacccagccaggttgcaacagttcctaggcttggccttaactttgagatcagagtgggtgctgggagctgggagaggccaggcagtcggagcaggtacttctgagcctgcagagggagggggaattccctttctgggcccttgagattgcagagatgcccgggtccacagccacagcttgggtggctgtggctgcagctgcacccaggagggtggggctcctgcctgctcccagcccccaagagcacagggatgcccaggtttgcagccacaactgggcagccacagctgtgcccagggagcgtgaggctctcaccctgccaactcagaagggggcgaggcttcttccacccatttctggctcctgtcggttctgtggagcatgcagccctggctgcgcctctcctactgcagctggcgttacggcagtggctgctccagatgggctgccattgccatcataatgacctggatttctcttgccaacctctccatgcctcaccgtcttcttattgctgatctttggaggtttgctggactgcactgttcaaataaattgagttttttttgaaaagttagtatctttacctgatgtcccggtgaagctgaattgttttaaacatttgggaactacaaagtgtacatgtttctgggttttcttttggattggggttcccatttctgggccattttgcttctctctcactctcccctcttctttttggtcactagatttttaggccatatttttcattgtagggggagctgggtaaatttttagaagttggcagtgacagagtggcaattaattagaagttggatttagccaactataaatttgtctcatttacatttttctaaattaagtctaataagcgaggaattttccctaagctgtgaattggaattaattatggttcctcacagaaaggtaagaatagtaggagtactaatgttgaaaatgtggccttgtgctgtaaattttttaacagctctttctcatgtttctttaccaagagaatcatggttctttctttctataagaatttatagaatgtgctgtcttttacagtgtgcttggaagtataaaacattaagtgcagctttatctgttggcatgctttgctcaaagtggttttgccctactcctgagagagagccagatttgtccccattggccttttgtgcattacacaccttagaataaataataaaaagaaaataagtgttaataataatagatttaatgaaatcaaatttaaaaacaagtatgtaaaacattaagatatttagactttcaaaatttgcataaaaattctatgatagcttacttggttcataattttttttaaccttctactttgaaaatatttgtaacctatggatagtttgccggaatgctacaatgtgcttctataaacttttcatctagattcactaagtgttagctttttgccagatttgcattttccgtctctgggaacttattattgtggttaatatttttaaaactttatacatcttttggttgccaggacacaacactttttgatctcagtcagtttggatcatcaaatacaagtcatgaaaatttacagaaaactgcttccaaatcagctaacaaacggtccaaaagcatctatacgccgctagaattacaatacatagaaatgaagcagcagcacaaagatgcagttttgtgtgtggaatgtggatataagtatagattctttggggaagatgcagaggtaagtcgtcttttcaggcactattttatatttttcttgtctagccttagatatttttcagtatttttgtttcattttctgaccttatataaaagctgatttgatcaatcaccttttaaaaaatactgttatgtaaagtaaaaactaaaaatgaacacaagaaacttggtgggaaccagacttggtgggaaaaagtgaggggtctctattggaatgttagcgcttattctccgtggtactaggccagtactttttatccatccaaagttaattggatgagtcaattagtgaataaaccgtaatcatgtaaatatgttttctaatgaagactcaagcaagaaaacatttttgagatgtatagaagttcctctgtttactcttaatttatgaattttcatagccaggaacaaagttaagtctcaatggaagaacacgtgaactttaccagctaccaccagaagttgtttgaagttttacagatctctttgggtgtcagtcaacttggtgtcttagtctaaattgggattgtgccaggtgtggtggctcatgcttataatcccagcacttcgggaagctgaggtgggtggatcacttgaggtcaggagtttgagaccagcctggccaacatggtgaaaccgcatctctactaaaaatattaaaaaaattagcccggtgtggtggtgcatgcctttagtcccagctcctcaggaggctgaggcaggagagtcgcttgaacccgggagatggaggttgcagtgagccgagatcctgccattgcactctagcctgggcggcacagcaagactctgtctcaaaaaaaaaaaaaaattgggattgtatttaatgttgaaatatttattataggccctagtcaagaaggttgaaagtgaaatttgaacatttcataggcaaacttagggaaagtattgcagatgacacctttgttggaagtcatgaatgcttgtgatgattctatagtttgggacctggttggattgtacactagagagtgatgaggtagcatgtctgtgcttcttggatgggaagtaaagacttggccaactttttttcttcaagtttcctaaatcctctgtggcaggcaagcagcgttctcaaagtcagatgcattatgcaatgttctgtgatattaaattaggctctgagataatgtcaccatgttttctgagggcaggaacaaatatgtagttgtcatcccctaggcgaaggagagaaactgtctaggttaaacggtaaattcagacctgaccacggtaaaggctgatgtttttctgcccttctgtgagggactaatagagttcagagaaggggtgaggttggggagcgagagtgttagaattagagttccatggcttcagtgggcaatatctaagccatggtgctttctagaggaaatcagggaatcacatggtgcttcatggttctatatttctatcagtcgtgcatcattaattagttagccagcctggggtttctctttttactttttcaatgatttctctgtccggatgggttcatcatttctgcatactctgtagtgtcttctaaatgtcagtcatttgcacatgccatgtagcaaattcttactcttttacagtctcatgatctctgtattggatagtctttgtgtagggaaagctctaaggatgtagaagacctgtcatatttttctgagtcttttatagatacagatgttgatactgaagttaggtcactggaactgcccaaaatacattaaaccataggcttctatacagggaacatttttttaaactttttattgacatagtacacatttagattaagtgtacaaatcctaaatgtataccttgattaatttttaataaagtgaaccaacatcacatagggaatcttaaaatataaatttattgatattttcttttttcattttttagattgcagcccgagagctcaatatttattgccatttagatcacaactttatgacagcaagtatacctactcacagactgtttgttcatgtacgccgcctggtggcaaaaggatataaggtcagctttggctttaacttgtggggaaaggaaattgggattctcctccagagagtgcaaacgtgttttgtaaggtggtaggtaggcttcaattggtttagaattttgcattttacagaactgaaagtgtttcataattattagtattatgtatttatgagtttttaacatattgttagatatttagggtaaatttttaaactctatgatagtgtttcttagcaaattatccacccttgtcaactcctttaaaccctacatctgaacgttgtggactgattattttaaccatttcagaattgacgtttaaacatttcgaaatgagtttttacaagtcattttttatcctttgatagcaatatttcttatttttgttgaaggtgggagttgtgaagcaaactgaaactgcagcattaaaggccattggagacaacagaagttcactcttttcccggaaattgactgccctttatacaaaatctacacttattggagaagatatcctttttggacgggagtttttctcttaaatgatacaagggctttgttggcaggttttgtttgtttgtttgtttgttttttagttgctctttgggaactttttagatgagctgagaggcattaaggtgaacccttgattaggtgtgctattcaagagggaagtagtggctggaaacaagcatcttttcacatgtcatagtagaaggcaagttcatcatacttcaagagcaagaaaaaaagcaaccctaataaaagacgatgtcaggttagtatctgatttgaaattatatcttccttagcccatttgtgggaagtagttaggtgcttagggcctacaagctcctcagggtctttccaaagtgagacctaaaaagtaacttattgaagccaggcgctgtggctcatgcctttaatcccagcactttgggagactgaagtgggcagattgcttgagcccaggagtttgagaccagcctggacaacatggcaaaaccccatctccacaaaaatacaaaaaattagctgggcatgttggcacttgcccgtagtcccagctacttgggtggctgaggtgggacaatcacgtcagcctaggaagtagaggctgcagtgagccgtgatcatgccactgcattccagcctgggtgacaggagtgagaccctgtctcaaacaaacaaacaaacaaacaaaccaaaaattcaaaatgtgaaaagagaactggctgaagtcagaattaagacagagttaaatgcctataaaatatagtggtagcccgtcttcattaattgttaactttataaaaattttattacttttgaaaatgggctgtgggtgaagttttctcacttggtaagaattttcaatgtgcataatgattgcccctaaatttacggtcatttataaatgcagtgtgttatttgatgccaaataatttcaaaagcaaaattgtcagtttcaaaagccaaataattatatgtaaaattagaccagggtgcatttaaaaaaaattactatgggggtggaatcagttctctgataatggaagaatggagagataagaaggccttaaatgatactgtgtgaaagtattatttctgttatggtttattacagatctgcttatttctcagctcatctaattctaaggactgttttgttccatgaatactataaatagggaacagctatcactcaaaatgggctccaaactattaacagccttgtgttgttctaagctgatcaggctgtaagaacctggtatttttattttttcttttgctaaagcttgagtctgttatttgaagcccatttctagtacagtccccctccctgcttttcctttgctgcttttatgggtcctatgtcctgatgtccaaagatatgtccagactttgccccaaatcagctttcatccctgagatttagttaatggactcattttatacacacatacacagacatacatgcacatataatgtatatatgtttctgttttctcatgtctttaaaaaattgtcttgctatatctgggagcttttaggtacattaaaaaaggaaaataatttacacccttttagtgtatttatactttgaattgtggaattaaacattatgggattgttaaggattcaagtctcagcatcatccaagtgatgaagtgggttgatatttgggcctccatggggtctggtgtactccactaagccctttggaagtaagatactggttatctgtctttatgctctttatatcttaggaaagataaggcatgcaactatgatccaaataaatcagaagaatgaatactgggcagaagatttttgcaaagggcagaagtactgtgtgaaatgaaccatcattttattatttttttctttatttttatttttttattttgtagagacagcatcttgctttgttgcccagggtggtctctcaaactcctagccttaagtaatcctaccaccttggcctcctaaagtgctgggattacaggtgtgagccactgcgcctggctgtgaaccattattttaaaggagaaaatagttaatattattggaaatttagcatattaggatttagaatttagcatataattatttttctttaattattattaaatgtgaatcccctaatcaagctggatgatgctgtaaatgttgatgagataatgactgatacttctaccagctatcttctgtgcatctctgaaaataaggaaaatgttagggacaaaaaaaagggcaacatttttattggcattgtggtaagtactttgcaggtgaggaacaaatgttagatgttcatggtatctctaaatatgatctatcatgtatggtttataataaggatatctgatgaagtgtaccttcagataattatacaagaaaaacatttttctcacaatattatatgttaaatcgctagttacaattttctcatggctacttggtacttgtagcagtccattctcacgttgctataaagaaccacttgagactgggtaatttataaagaaaagaggtttaattggctcatggttccacaggctgtacaggaagcatggctgaggaggcctcaggaaacttacaatcatggcgaaaggcgaaggggaagcagtgacatcttcacaagcacaaggctagcaggagagagagtgaagggggaagtgctacacacttttaaacaaccagatattgtgagaactgtcatgagaacagcaaggaggaaatctggcctcacaatctaatcacctcccaccaggtctccccctcagcattggggattacaattcaacatgaggtttgggtggggacacagccaaaccatatcaatactctatgctatggagagatccagatggtcttggtccatgtgccctgagattttaaggttgaagatagacacaatggcagacatatgtgtggacaatgtacagatagcagaataaaacactaagccaacacaagcatggtggcaaagtgttctataaatttcctctagggatttgaaattaaacatgaatgactatggtattatatctagatttggaggaggggatagttaaagagaaatgataattggctgatataaaataccatactaaattaatattaggattatttacagtcagttttctagataaatgtaatttgtgaattatagttttatttatttatttctttgagacggagtttcacccttgtcacccaggctggagtgcaatggcgtgatcttggctcactgcaacctctgcctcctaggttcaagcaattctcctgcctcagcctcccgagtagctgggactacagtcacccaccatcataccaggctaatttttgtatttttagtagaaatggggtttcaccacgttggacaggctggtcttgaactcctgacctcaggtgatcagcccacctcggcctcccaaaatgttaggattacaggcgtgagccaccacgcctggccaactcatagttttattgattttctggcagtttatgaataaatttgctcatttacagacttacgtggactctgctaaaggtcttagactttttaaggcccttcagaacaatcagacaccccttttctgttgtaagttaagcacaaatggaactctgtccaagtgaaaactaattctctttgctttttctaatttctacggtcagtggcaatatcaacaaaaattcttaccatctgaatgtctccaatgtgccttttaataccttattttgactgcataactctgtgttaacttgacatttgcttaaccaataagcccttctttcagagagttagcattcctgttggtgttagacagctctaaatgatatttttatccttgagaagcacgttttatctagctacaggcatttggacctatatacaaatagtaaagttatttacttttaagctttaacatatgtaatgtgctattttatatttacctaaaactccttctaaagaacagagttgatagtatataattcctacttagtgcatttagaaataccatctggcttaccgccagagttaaccatgtgtgcgaactgggactcggaaaaatgaaaacagccgtttgcccttcaagcattttctttggggctgtcctttacttcagcaaccacttttgggctgatgacatcctgagctctgggtccaggctgcacctctctcgagctccaggctcctgcatccaaatttttattgaacagagatacttagaatttactctggctcctcaaactcagtgtggccaaaattgatcttatcttcttttaccctcgacactgttttccctgtcacaatgggtgtcactcattgcctggtcagtacctgggagtcaccttttgagtattggtaattagtctgaaattcaaagggctttgctgttgtagtatcactgcagtcaggctctgtgccttcagtctgggcagtgcagttttatacacactgattttaggtttctcagtgtgatacatatcacacagggtgatagatattgtgggtattacagtgtagaccatttctctgattaaagaaaaagggaatttggctgactgaaaaatttgttactttaacatctgtacctggtttttgtaaatgcttggtttgtagattggtatataaatttacatgtgtatccttatgtactgatagtccatctctctaggctctagagaaagcctctgggctagaattaaggatgttccttaattacagttagaggagctataacactgcctccaacccataagatccctgggtgtccattccctccagaggtgtctgtaatccagactttgaagatgataatttccttgcttttagttggagcttctagttccagccttgccaccttaaacgttatatacaaatgtaaatatagtgtgtgtattcttttgggttttgctccttttgtttaccattttgtatgtgagatttatttacatgtgtcgctgtagttctctcattgccttttcctatttcattttatgatctacagtttattcattcctgttgatggacatgtgcattctttctagtttacagttgtacagagaatgctgctgtaaatatttttgtatgtcttgtatcgtatacaaatgcctgagtttctccagagtatatccttgggggaggaattgctgaattatagggtgtggatacttcaacattcctagataatgccttgctgttgtcagaagtggctttccatcagtagtatatgaacatagggattggtgatttttcctctttttagctaatgcagcctgtaactagcccccatggctttcataagcatccgtagtggctaacagtgtggattggggagtagtcagatttcctgggtttgaatcttgactctactccattgtcactctgggaccttggctagaaacttcctatcacttctccaaaccatgatcttttccagtttatctttgctattattggcttaggatgttagggagcaggttcaagttggcatgattattctactggatagactgtctacttgggcttcattcagagtttgataaagtatacattttatgtgttactttgatgtatgaagtagtaatttactacagtactggtggtctggttactaggaccatgtcacttgttactttgagtgataactactatttgtacagtgctttatagtttacaaataattcctgtttattttataatttgatccttacaataaccttatgagagaagtaggctggtttggttccatttacagaggaagaaactgaggcctggcagtgtttggtaacttgccatagtcactccgttaggtatattaactccaggccttgtattcagggcggctctcggaaatctgatttatagtatcatttagatatctgtgagtctgactcttcgtgtaagagtcctgaaaagcagacaggtttctaacactttagaaatagagtacatacatactcctgagtgtatcatctttactttttccatgtttatgctgtgttatagccataactggggaaatacattttttctgtaacattatatttgtatttgtttttagggagtgcagcctgccacaggcgaggttgtgtttgatagtttccaggactctgcttctcgttcagagctagaaacccggatgtcaagcctgcagccagtagagctgctgcttccttcggccttgtccgagcaaacagaggcgctcatccacagagccacatctgttaggtaagttggcacatcactggaatataataccgattctgaaacttaggtttagttccaaaactgatacttattaaagttgctaaaaatagtttttacttacaaaaattatatttccactgtagtagtggaaatttaaaaaaaaaagtaaaacaacaaagctgggcatggtggcacatgcatgtaatctcagccacttgggaggctgaggaggaaggattgcttgagccccggaatctgagaccagcctgggcaactaaggtgagatctcatatctaaaaaacaaatagaagaaacaccacctacccctactatcaccttaatgtagaactttagaaggcagtctttttgaagaggtttctgatatttaatgatattatttgataattatggggtttatgatatttaattattggtaatcttcagtttctagagataatttagagttcacttcttacaaagtttatgtaactttggagatgctttgtctgtgctgcaagtttcaattcatggctgtgtccagtggttttgtttactggatctaagatcagaccacttacgtatgaagcagtgtgctaggcgctgtgcgtacagaggaagaagatgtggttatgatatatgtctggcagagtttacaacctcacatgagagtcagatgtgtgcatacctaactggacttaaaggcatgatgtattaagtgctaaacgtgaaggtgccttgttggaaagactccgtactgccacctggagtgtggtgggaaagagaccagaaaggtgtgctggggcttcagcgaagtagactgtatattgacgaatttggactttggactaggcagagaagcccatgaggattttcatgtagtaggtagacaaatcatttagaaaatcgaggccaggcacggtggctcacgcctgtaatcctagcactttgggaggctgaggcgggtggatcacctgaggtcagcagttcaagacagcttggccaaaaccccgtttctactaaaaaaaaaaaatacaaaaattagctgggtgtggtggcagacacctgtattcccagctaccccggaggctgaggcaggataatcgcttgaacttgggaagcagaggttgcaatgagccaagatcacaccacttcactccagcctgggcgaaagagcaagactcttatctcaaaaaaaaaaaaagaaaatcaaactgattgattaagtgaagttccatatgtttctttgtccttagtgttgtgttcattttcatttgaatttaatttctttcgaagtagctttcataatttgtttttctgattataaaactaatatatgttcattcagaagacaaaaaaaaaaggataaattcataagttgaattctgtaacccagagaaaatgactgttaaacattttggcacattatttccgtgtgtgtatatcacttttttccatttgtgaacttgcattcctgctgcaaaatcacttttctattctgtggtttttttttttttaactttacaattccccatttttaaaaactttattgcagaacatttcaaacatacacaaaattatacagaatagtgtcatgaactcctgtcactctattagccagcttcagcatttctcaggaccattctcatttttctacactccctccccttttctctctcccttgattattggctttgaagcaaatcctagggagcatcagtttatcctctaatatttcagtaggtacccttaaaaacaaaataagtacatgacattgtcatataagtgtatcataatttatccattccatttttattatattcatttttccagtattataaatactgttatgatgaatatccatatacagaaatactcatgtgcgtttctgatgatttccttaagataaattcctgaaaatggaattaactggatcagaaggtatgaatgtttataaagctcttgattgcttgctagaaatggtaatatcaatttatacttctaccagtatagtctaggagggttctttgaacctttgctcacattgagggtgatcatttaaataatctttgccagtcacatagatgaaaaattttgcatcaaatctcttcattttgatcttaatccttttctgaccatgtgttcaaacttgaataattaaaagtcaaacagtaaacttgtaaggagagctgcttttacagaactaaaaaaattaataaaatctggaaaaaaatttttaaaggtaggcttctatattgtattttcaatatttcctatcatttccttgctagaaatggtaatatgagaaatggtgatcaagagctttataaacattcataccctctgatccagttaattccattttcaggaatttatcttaaggaaatcatcagaaatgcacatgaatatttctatatatggatattcatcataacagtatttgtaatactgaaaaaatgaatatagaaatggaatggataaattatgataaattatgataaatggataaattatgatttcctgtctttgatttagttcatttttctttatattttattaacttagtatatattttattaacttagtatatattttattaatttagattgagtaaagtcaatcaattttatcaacacattcatttttttgttttctgcttaattttataaaataacaatggcgaaattcaataaaatatcaaaatatttcataatgacattgtcaaaagtgaatttttgtttgtcaagcagcattcattgactggtgatattcctaaatgtttgttcatcacatgagatttaaaagcttgaatttggcatatcaaagataatttaggtgtcttatgtgggttttaccaaatttaatgcctgcttttgtcttattttaatttgaatttctctagttagcattgtaaataattttctctatgtttactgaccgtgtgtaatttttcaatctttgcacttttttttgtatcctttgatcattttcactttatttgcatattggactaagcgaagtcaaaagttaaatctgcatttctgtggagttcctacagctaatttatatctatggacagaatgaagtagaggaaattcaaaagttagcaggggtcaaacagtgtggactcttgtgactcagggtttgagttggaaaactagctcttccctttagtgactttgagtaagttatctactgtattgtccttcagtgtcctttatattgggggtattaagagtgcttacctcatggggttgttgtgaggattaaataagttaatataggtaaagcgcctgaaatagtacctgctgtagaaggctctctgtaagaggaagtttttttttttatattttaattaaattttctgtggctgggcgcagtggcttatgcttgtaatcccagcagtttgggaggccaagtcaggcggatcacaagatcaggagttcgagaccagcctgaccaacatggtgaaaccccatctctactaaaaatacaaaaattagccaggcatggctaaagttttttgtaggtacataatagatgtatatatttatgggttacatgagatactttcatacaggcatacaatgcataataattacatcagggtaaatggggtatccatctcctcaagcatttatcctttgtgttacaaacaacccaattatactcttttagttattttaaaatgtacaattaaatgatttttgactgtagtcattctgttgcactatcaaatgctaggtcttattctttctattttttttgtacccattaaccatccccagttcccttctcagcctctggtagccatctttctactctctatctccatgagttcagttgttttaatttttagctcccacaagtaggtgagaacatgcaaagtttatctttctgtgcctggcttatttcatgtaaaataatgacctccagttccatccatgttgttgcaaatgacaggatctcattccttttcatggcagaatgctactccattgtatatatgtactacattttctttacccatttgtctgctgacagacacctgggtgctcgcaaatcttagctcttgtgaatagtgctgtagtaaacatgggagtgcacatatctcttctatatactgatttcccttcttttgagtatatatctagcagtgggattgctggatcatgtggtagttctatttttagttttttggtagttttttttcaaactactctccatagtggttgtactaatttacattcccaccaacagtctgtgagggttcccttttctccacatcctcaccagcatttattattgcatgtctttggataaaagccattttaactgaggtgagatggtatctcattgtagttttgatttggatttctgtaatgaacgatggtgttgagagcttttcacataccaggctgccattgtatgtcttcttttgagaaatgtctattcaatttgtctatttttaaattggataattagatttttcctgtagagttgtttgagctccttatatattgtggttattaatcccttgtcacatgggtggtctacatacattttcttccattccatgggttgtctcttcactttgttgattgtttctgttgctgtgcagaagctttttaacttcatgtgatcccatttgtccatctttgctttggttgccctattaagaaatctttgcccagttcagtgttctggagagtttccccaatgttttattttagtcatttcatagtgtgacattttagatttaagtctttaatccatttttgatttgatttttgtatatggtgagagatagggtctagtttcattgttctgcatatggatgtccagttttcccagcaccatttgttgaaaagattctttcctcagtgtatgttcttggcaccattgtcaaaaatgagttcactgtagatgtatggatttatttctgggttttctgttctgttccagtggtctgtgtgtctgtttttatgccagtaccatgccattttggttactatagctctgtagtataatttgaagtcaggtaatgtgatacctccaattttgtcctttttgcttaggatatatttggctattctgagtctttcgttgctcatatacattttaggctaattttttccatttctgtgaaaaatgtcactgatattttgatagggattgcgttgaatctgtagattgctttgggtagtatggatgtttgaactattcttccaattcatgaacatgtaatatctttcccttttttgtgtgttctcttcaatgttttacatcagtgttttatagttttcattgtagagatctttcacttctttggttaactcctagatattttattttatttgtagctattgtaaatgggattacttttttgatttctttttcatattgttcactgttagcatatagaaatgctgctggttttttgtatgttgattttgtgtcctgcaactttactgaatttgtttgatcagttctgacagttttttggtagtctttaggtttttccaaatgtaagttcatctcatctgcaaacaagaataattagacgtcctcctttccaatttggatgccctttatttctttgtcttgtctgattgccctagttaggactattatgttgaatagcagtggtggtagtgggcatcattatcgtacttagaggaaaggcttgcaatatttctcaattcagtatgataatagctgtgggtctgttttatatgttgcttttgttatgttgaggtatgttccttctatacccagttgtttgagagtttttattatgaagcgttgttgaattttatcaaatcctttttcagcatcaaatgaaatgattatgtgtttttttttcttcattctgttaatatgatgtatcatagtgactgatttgcatatgttgaaccgtctttgcatctctgtgataaattctacttggtcatgataaatgatatttttaatgtgttgttgaattcagtttgctagtattttgctgaggattttcgcatcaatattcatcaagagatattggcctctaattttctttatttgatatgaatttgtctcattctggtatcagggtaatactggcctcgtagaatgagtttggaagtattctccttttttttttttttttttttttcccagaatagtttgaggaaaatgggtctagttctttaaatgtttggtaggattcagcagtgaagctattgggtcctgggcttttctttgctgggagactttattatggcttcaatctcgttacttgttattggtctgttcaggttttggatttcttcgtggttcaatcttggtggattgtgtgtgtttaggaatttatccatttcttctagattttcggatttattggcatatggttgctcatagtaaccactaatgatcctttgaattcctgtagtatcagtagtaatgtcttctttctcatctctaattttgtttatttggggtttctctcttttttcacagtctgggaaagtcttaccaattttatcttttcaaaaaactaacttttggtttgttgatcttttgtattttctttgtttcagtttcatttatttctgctctgatttttatttttattttatattaattttgggtttggtttgctcttgcttttctagttcttcaaggtttatcatttggttatttatttgaaatgtttcctcttttttcatgtaggtgcttttagctataaacttccctcttagtacagccgtcactgtatcacataggttttggtatgtgttttcattatcatttgtttcaagaaatttttaaatttccttgttgatctcttcattgacccactggccattcaggagcatattgtttaatttccatgtgtttgtatagtttccaaaattattcttgttttcgatttctagttttatttcattgtggtcagagaagattcttgatattatttcagttttttgaatgttttaagacttgttttgtgacctaacatatgatctaatctcgagaatgtttagatcattcatgctataatgatcagatcctctacatgctgaggaaaagaaagtgtattctgcaaccattgaatgaaatgttctctaaatatctattaggatcatttggtctgtagtaaagattaagtctgacgtttctttattgattttctgtctggaagatctgtccaatgatgaaagtggggtgttgaagtatccagctgctattttttttctctctcttttttttgagacagagtcttgctctgtcacccagggggcagtgcagtggcatgatctcagtacactgcaacctctgcctcccgggtttaagcgattctcgtgcctcagcctcccgagtagctgggattacaggcgtgcaccaccacgcctggctaattttttttgtattttagtagagacaggatacggggtttcaccatgttgtccaggctggtctcgaactcctgacctcaagtgatccgcctgcctcaggcatgtatatttacaattatcgtatccttttgctgaattgacccctttgtcattatataatgaccttctttgtttccatatttacaaccagtaaacaatacagtattaaatttgcaagtacaaaatttgttttgtttttggtgatatcttcttgtctgttttaaacactggtaagtagtttcttgtatctcagactaagtaccccatttttttcttatgctatatacctaaaggtaaaaacagcagtttttgtcagttactggttaataatattttattaattttgaagacataatatgttaaagctgtgtgaggaaaggcaaaagaatggcttggaattgtggagtgtctatcttaaaatattagggtttttggtattcttaactttaaccacaagaggtctccaaaggatttgatattttgtgaattactgtttaatggttactaaaatcttcacatttctttttatatctgaaagtacaggtttatttactttgtatcatattgtgacttagaacaaatattagagatgatagtaatctaaaattattactcctaaataatgatacactatcaatttttcttagattatttatttttatttatgtaaagtatgtttgtaagatttcagcctgtgtcttagggaatcagtcttactatcttgttacactttcttttgttgtaaaaatgtagagaaagaaacaaatggaaagcaatagtctcgagccctttatcaattgcagttaaggttgctttagcttagaaatgttgtatgtttatagaaatggttgagaggaaagctttagaaagcgataaacaaataatatttactagttctcaaggaaactgacttttcaggtgaatcaggtgaacatcacaaatgacactcaattttgcgttcaaagaaatgagagcttcctgagcactggcatagccaaggaaggctgtatgaaggaggtggggtaggctggtacatttgcagaatagaaggctttgagttggtaatggggaggggggaagggtatgttgtgtgtgtatggaaatgatatgaggtctgaggcacacaggctggaaatattagagaagtgtgaagacagaagggagatttctctgattagagggaactttcatgttgagaattgagaaagaaagggtgaaggcctatgaaatccagcaaactggtatggattcctgtagaaggcagtaaggtttctgggaaaaggaatggcatgatagaagggaagagatgagtgtactgcctagatgggacagttgaattttaaaaataaatatttccctaaaggaaaaagcggatacagagaaaagaatcagatcaaggagcttagagaatgccaatagttgggaataggagcaagaatacaaacagaaggggaggaattaaagagctaggtggagaaccaggacaaggtagggatgtgtagttataatttgtcacacgtggtataaccaatgatgtgagctaattttttacattattgactctgttatagtttactgaaactgtatgacattcagaaagatacttggttaaaaactagccttagctcattgatatcatttgaaaaagacatgtggaagaatgtcctgtggtaccacagtgactttagctatctgacctttgaaataaatgcttgaacacataagtgcttcctcaaagatagatgtgtatgctgcagatttaaagaaaacattgaaatcttaatgttggggaataagaataacctctactatgtttactttcagtgttagaaataccttattattatgtctttttggccacagagagccttacatcatctgaggtttaaccaaaagtattatctaacatgattctttatgcggaggcatagtaccacctgaatgtcacttatggtgacacgtgtttgaaattaccatagtagcattttcattttgtgttcatctcttattaaattaatttatatagtagaaatcacttattactttatgttattgtactttgactttcaagtttttaatggaaaatatttagcagagttttggtgccaaaatgaagtgataactgtgagactatataattatcagaggaattgttatgcaaattaggtatctgtgttatgactgaagtccaacttctttctaatgtcatttgaattaaacattagtataaaggtttcaatttttttttttttaaagaatgagagtaaaagaaacaacaggtcttactcattaatttggttaagaggaagtgcttcacacatacgaaatgttattaagtggtcggtacttgatggtaccaatttcgtgattgcagtgttacagttctatcaaagtttaataagctcaattctgtgggttcatatgaagtcatttcaatataattcttagatatttagagccaagtaaatgtggaatggcataccaaacagtgggtagcatatagatatgaataacatggtgcctaaattaggtgggaaggtgggactgggtagaaagagggcattccaggaagtgtggtcacaggatgagaaaagggaattgggaacatcgagttgactggagtgttaggaaaatatgggtcaagagtagcctgcaacagaatgtagtgcagaagagctgttcagtgagtatttgctgaatgattatgtttaaggccagagaggaagactggagctgtttcattgaggatgctggctgggcactagtgggaggagcttatactttatttagatgtttctcaaatttggcctaccaaccttttaatttactactttgtgttagaattttcttatttaaatttgttaaattataattttaaaatttacaaagttaatacatgtttgttgtaaaagtgaaaaaagtctattttaaaggaaaaaataattcttgctaacctcctcacccatttcacttaaattagttttattataatgtgacttaaatatttataaactgaaaacttagtgctctaggttttatacctattttaacaggaataaagtccaagcaaaatttgagattaaagtaaatgtatgaaacaaataaaatataaatgaatgattgtttggtatgaagggtgatgttctgctgctaaaaataaactgttcctaccagttcaaggggatatatccccaacggaagaccgagttctttttttttttttttgatctttattttattttattttattttgagcagtttgaggctcacagcaaagttgagagtaaggtacagaataaaagtgtcatatcatcagtattctccaccagatcctgtgctatgatattgctgtaatatgctgtgtaaaggctcaaacctttcctgcatgatttttttaaagagtaggggtctcgctctgctgtccaagctggattgcagtggtgcggtcatagctcattgcagccttgaactcctgggctcaagagatcctctcacttcagcctcctgagcagcatactaatcaggcacatacctgtagtcctggctactcaggcatgcaccaccccttacagctaattttttaaaaaaaattttgtagagatgggttctggctattttgcccaggctggtctcgaacttctggcctgaagtgatgctctcacctcagccttgcgagttcttggaattataggcatgagcgactgcatttagcatcttccagtctttttctttcttcaaaccacagtatgacttaagtggtttgccctccgttgggtaccagtgtaccagttccatttttgttgttgttgttgttgtttttgagaggaagtcttgctctgtcacccagactggagtgcagtggcacaatcttggctcactgcaacctctgcctcctgggttcaagcgattcttctgcctcagactccccagtagctgggattacaggcgcccgccaccacacccggctaatttttgtatttttgtagagacgtattttcgtaggggtttcgctgtgtaggtcaaactggtctcgaactcctgacctcaaatgatccgtccgccttggcctccaaattgctgggattacagacgtgagccactgcacctagccatccagttcaattttaaaactactgttttatttttctcattaaactttaaccgttaagtgctccttattactaatgtgatcttaaacataaacagaaatgcagaaactgaagcacgtagcaatattcattttaaaagctgataatccagttgatctaagaccttaacctaagatcatgaaatcagttcggtaggttgtgactaacattttaaaaaaatacagtagaagttaccagagtatatcacgtgtagtaagggtaagtatttcatgaaattcctttttttcagttttatctgtttatagataatctgtctgtatatgccttctaatcctctctccaattcctatcatgtttgtaattgtccatgaaaataattaaactcataatttaatatattaatatgattaataaatgttattcatagattattttatatatacattcttattacctgaaactgatcagatactgcccagaaatatatttttgaatagcacaactgaaaagtagttaatatttagactacgtatttaaaatcctaaagctgacatgattcacagaccagatattgcctacatagaaaatctagaagtgacaaattatcagaagtaataagaattcagcaatgccattaaatataagatcagtttataaaaatgaatagtgtttcagtacagcagcaacaaatagaaaatgaaaaaaattttaaaagatactatttaaaatagcaaccacaataatattatctaagactctatttaccaaaaagaaaataaggtcttaacgaaaatttggaaactttactgaaagatattaaagaactaaataaatactggaaagatgcaacacgttcatgaatggaaagattcagcataaagatatcagttctccttaatataaattcaatgcaattcttttttttttttaaataacaattttgtgagtacatagtagggtacaagagatgtttttcagtgcaattctaatcaaaagggcaatgaggtttttcacagaaactgacaagctgcttttaaaaagatagatcaaagggccaataataagtaagacagcactgaaagacttagagctatttgccctatcaaaactcaaaacttacatatatatgtgtgtgtatatatatatttatatatgtacatatatatgtttatatatttatataaatatatctaaatatatatgtatgtttatatagataaataaacatgtatatatttatatagctaaacatgtatgtttatatagataaacgtgtatatgtttatatagataaacatgtatatgtttatatagataaacatgtatatgtttatatagataaacatgtatatgtttatatagataaacatgtatatgtttagatagataaacatgtatatgtttagatagataaacagtatgtttagatagataaacatgtatatgtttagatagatagataaacatgtatatgtttagatagatagataaacatgtatatgtttagatagatagataaacatgtatatgtttagatagatagataaacatgtatatgtttagatagataaacatgtatatgtttagatagataaacatgtatatgtttagatagataaacatgtatatgtttagatagatagataaacatgtatatgttagatagatagataaacatgtatatgttagatagataaacatgtatatgtttagatagatagataaacatgtatatgtttagatagataaacatgtatatgtttagatagataaacatgtatatgtttagatagataaacatgtatatgtttagatagataaacatgtatatgtttagatagataaacatgtatatgtttagatagataaacatgtatatgtttagatagataaacatgtatatgtttagatagataaacatgtatatgtttatatagagagataaacatgtatatgtttatatagagagataaacatgtatatgtttatatagatgaatatatataaacatgtatatgtttatatatgtttatatagatatatatatacacatgtatatgtttatgtttatatagataaatatacatacacatgtatatgtttatatagataaatatacatacacatgtatatgtttagataaatatacatacacatgtatatgtttgataaatatacatacacatgtatatgtttagataaatatacatacacatgtatatgtttagataaatatacatgcacatgtatatgtttagataaatatacatgcacatgtatatgtttagataaatatacatgcacatgtatatgtttagataaatatacatgcacatgtatatgtttagataaatatacatgcacatgtatatgtttagataaatatacatgcacatgtatatgtttagataaatatacatgcacatgtatatgtttatatagataaatatacatgcacatgtatatgtttatatagataaatatacatgcacatgtatgtttatatagataaatatacatgcacatgtatatgtttatatagataaatatacatgcacatgtatatgtttatatagataaatatacatgcacatgtatatgtttatatagataaatatacatgcacatgtatatgtttatatagataaatatacatgcacatgtatatgtttatatagataaatatacatgcacatgtatatgtttatatagataaatatacatgcacatgtatatgtttatatagatatacatgcacatgtatatgtttatatagatatacatgcacatgtatatgtttatatagatatacatgcacatgtatatgtttatatagataaatatacatgcacatgtatatgtttatataaatatgcacatgtatatgtttatataaatatgcacatgtatatgtttatataaatatatatgcacatgtatgtgtttatataaatatatatgcacatgtatataaatatatataaacatacatatatacacacacacatatacacacacacacacacacacacacaaacacatatatatatatgttttttggagatgggagtctcactctgtcacccaggctggagtgcagtagcacaatcttggcccactgcaacctccatctcctgggttcaagtaattctcctgcctcagcctcccgagtagctgggactacaggcatgtgtcaccacgcctggctaatttttgcatatttttagtagagatggggtttcaccatagtgtccaggctgatctcgaactcctgacctcaaatgatcctcctgccttggcctcccaaagtgctgggattgcaggcatgagccaccatgcctggccaaaactcgaaacttataaagcaatggtaagttagtatggaattggcatatggagagagtagcaaatgaagcaatggagcagaagaaagatggagaaaacaaattcatgcatacataggaagttcatatggcagagatggcattagacatcctgggagggagggattattcaactgatgctgcagggacaaacagctttccatactgtaaaattaaaccctacttcagaccatacagaaaatttcagttggaaaatatatatgtattcattacctcaggatctgaaaagatatcctataaatgacatacacaaaaagcacaaatcaaaggaagtaattagtaagtcatgtagcttttttacaggttgctctaggtattacattatatatacataacttatcacagtgtacttgtgtcattgttttaccagtttgagtgaaatataaaaactttacctctgtctatgcttctttatcctcccccatttataatataattaccttaaatattataattgtcttaaatatttagaaagcgttataatttttccttgaaccatcacacataatttaggaaactcaggaggggttcctattgcttaccttgctgtttctttcctgatgttctaaggtttctttttttttattttttcctttttgtttagagaacttcctttaaccattcttttagagtagctctgcttgtgtcagagtctgttagtttttcatcatctgagaatgccttgatttgcctttcattttttggaagatattttttgccaggcatgggattctgggttgacaattattttttcagcacttgaaaaatattttgccacttccttctaacctttatggtttcagatgagaaatctactatcattcaaattgttttaccctatagctaaggtatgatttctttcttgctgctgtcaagaatttttttttttttttttttagtttttagaagtttaattatgtgtcatggaacatatatctttggctttatcctttttggggttcactcagcttcttgaatctgaaagttgatgtctcttgccaaatttgtgaatatttcatctattatttcttcaaggtttttgttgttggtggtggtgttttttttgttgtttttttttttttttgcctttcttttctcctcttgggactttgatcacaagaatgttagatcttttgttatagtccctggggctctattcattttatttttattgcagtctgtatcctctctgctttccagatttggtaatttctattgttctgtttttcatttcactgattgtttcatctgtttcctctattgtgctgttgagtgcatccactgttattatatttttcacttctaaaatttttgttcattttttctttttttttgagacagagttttgcttttgtgcccaggctggagtgcagtggcatgatctcagctcactgcaacctccgccccccgggttcaagcagttttcctgccttagcctccctagtagctggtattataggcgcctgccaccacgcccagctaatttttgtattttagtagagatggggtttcgccatgttggccacgctggtctcaagctcctgacctcaggagatccacccatcctagcctcccaaagtgctgggattacaggtgtgagccactgtgtccggcccatttttttgtttatgccttctattacgttgcagagaatttttccttgccttgactttctatttttccatttgtttcaagcatgtgtgtaattgctgttaaaacatttagcatggctgctctgaaagctttgccagttaattctgacatctctgttatcttggtgttggcatctatcgattgtcttttttcattcagttggaggtttggaggttttcctgttatttggtatgatgagtgatttttggttggaaccagtgcttttttgtattatgttgtgagattctgggtctcatttaagccttctgttctagctggctttccctgacactgcttcagcagggtaggggtgtgctgcctccttattgccaggtggaggtagaaacccaggttgcttggtttccgttgaaacccgagggagatgggtgcttcttgttactgctgggtccctggaggagttccagcttcccatgtggcctccactgggccttctctgacaccatccccgtaaggagtgagaagggagtctcagtactgcctagtgggtgtggaagtccagtctctgtctggtgtttcgcctgataccatgggggttaaagcctcagtattggccagcaaggatgaacctcttgtttgctactgtatggctgacactgacacaatcccaactggagtttggagtgccttctttcaccagtgagaatggaaatctggggtcccagcctttgctagcatgggtgggaccacaggtttttctctgatgcttggctagagtagagcggttattggctaaaagttttctgtcttgctaggcttcctcttctctgggggtttgttgaggcttttttgtctgtgcctgttggtctttccgggttgtcagctttttcagctccaagtctgggttttatgctacaaaaagtaaacctggggaactcaccgtcatactgttcctcacatcccaagttcactagctggtctgctttctgctcacctttcagagtcgtcttatgtttgtttgacatgtaatatgcagggagtggtacttagagtaggagtggggaaacatatctccattccttcttcccagaagcagaagttcttcaatcaagatcttattttagagattgctctatgtataaatgaactttgcttccttggtgttattttgatctaattataataaaatttggacttagattatattgataatgccagtgtgcaaattttaactgcaatagaattgaattttgcacatgggtgaatctgattgagaaaaagaaaatcctattttttataattaaaaaactgcttttaatatttttagtgctgtttacagtttaagaatgttagtatatttttaaaagcacaaccagtggggaaaattctatcccttttcttggcaaattaacaatctaagcatacaaaaatttataggaaaattttgccagctctccatcagagtgctgtcatgatgattagttcatatttccttcttacgaagcttgccctttcttgtttatcacccacagaaaagcatcaaagttaaaaattaaaagtatttgaaggaacctccataccaagtggattcagagagcccagaggtcagaaatcgtgcagagtcttatgttgacagaggaatggccctgccataagaaaggtgcctgagttatacaaggtgttggcagctggagccaagttacacctggtttacttacctgatataattttaagtgcttcacaaataacgttttttaccttcatagttaaatatttacttaaggtatattaaaaacatataatcagtgaatcaaacctgtgatttcataaatgtgttgcaaagaaagattcttaagttggtatttgagttaaaaatgtgagttaacttaacaagaactatcaggttatagtagtgatgtccttacaaatatgtcagtattattgaaggtaaaggggaatgactgaagttaaggaaacatgttggagcaattgtaaaggcaatgtgtgtcacattttctgccacttgtcatttagattgtgtaagctaaatctagtataagtgggaccattgtttgaatgaaaaaaaatccaaacttgagatgtagagaaatatagatgaatttgaagcccagaaaggacatttaagctctcttaagatgagttactccattttttatagtagctcacctttttaaaggtattttatcctgctgtcaagtttattttattaaattggataccaggaaattctaattgatttttttatatcaaacaaatcgatgttatttatttatttttgagacggggtctcactcttcctcaggctggagtatggtggcaccatcgtggttcactgtagccttgaccccccaggctcaagcaatcctcccacctcaacctcctgagtagctgggactgcaggtgtgctcaaccacacccagctaattttttttgtagagatgaggcctctctatgtcttctatactggttttaaactcctgggctcaagcaatccacccaccttggcctccccaaaatgttggaattacaagcgtggaccattgcgcctggccaaaatctgcattttgatggatgtttccagtagattctcaagttgttgatacatcttctaagttgaacattattatacagtcattcatttattcatccttaaacacagttattgagtggctgctgtgcgccagctttgttactaggtggcaaggatacagaaatgagaaagatccctcctttccaagttcttatagtctagaggggaggtagtcatggaaataattgtaatgaaagcgctggttgaaaatatcttagagttactggcagcccttgagcatcatgctagtttgctagaggggtgtgttagaattgagactggaagaatgaatgccagtcaggtggaggtgtgagagagcgtgcttttcttaggaagcagaaactagtttggctgggttactctgccagcatgagcaggcaacctgaggcaggacagacgtgttttggagagaaagggtgtataaagctggaaaccatcattctcagcaaactgtcgcaaggacaaaaaaccaaacaccgcatgttctcactcataggtgggaattgaacaatgagaacacttggacacaggaaggggaacctcacacaccggggggcctgttgtggggtggtgggggggacggatagcattaggagatatacctaatgtaaatgacaagttaatgggtgcagcataccaacatggcacatgtatacatatgtaacaaacctgcacgttgtgcacatgtaccctagaacttaaagtataataaaaatatacaaataaataaaaaataaaaagagaatcaagagtgaaacggtggagtgagaaagcggcattacacagggcctggataaagagtttcctgtgacagagactgagctgagatggctggtgatggggaccgtagcctagtgaccctttgtgtacccagcacctatcaaagtagctcacacataataggtgcttaataaatgcttggtaaatgaatgattaaataagtgatgtttagaataaagagaataatgggtatctcctatttgtttttcttaacaaaactgatttgggttttttaaacatagaagggttgttgtaaggctgggcgtggtggctcatacctgtaatcccagcactatgggaggacgagatgggtggatcacctgaggtcaggagttccagaccagcctggccaacatggtgaaaccccacctctactaaaggtacaaaaattagttgggtgtggtgtcagcacctgtaatcctagctacttgggaggctgaggcaggagaatggcttgaacccgggaggtggaggttgcagtgattcaagattgcaccactgcactccagcctgggcaacagagtacaacactgtctccaaaaaaaaaaaaaaaaaaaaaaaggttgttggagtagctggaaatctatacattaacatatatggtaatcaatgtctatttacattatatagatttacattatacagatgtagccaattcatttactcttttggaaagatcatattgatttcttatcgttttttccccattatgtttatttctttaaaaaattttttaatatcactgtaaattgattgaagcatcctgacatttccatagatattcctttacagcaaatattaatgggatctacatggctaagttactgtttaaagattgatattgatgataactaggcactagcctcccctctggcgcttgaaaccttttctgttgtggtattcgtaggaaatctctttttttctttatattttgtcttccccattttcctcattcctcttttcgagagcagaagataaatataaagttgactactttgtcattctgtttcattatgtttattagacggtagtttcacttaactatttagataatctagaattagaaaataaattgtgggcctggcagggtggctcatgcctaaaatccgagcactttgggaggctgaggcgggtggatcacttgaggtccggagttcaaggtcagcctggccaacatggtgaaacctcatctctactaaaaatacaaaaaattagctgggcatgatggcacgtgcctgtaatcccaccttctcaggaggctgaggcaggagaattgttcgaacctgggaggcagaggttgcagtgagtcgagatctccccactgcactccagtctgggcgacagaacaaatcaattctggtagtagagatggtagtgactaaatggaagaaataaatctcatatgctgtaggaaaatgtttgccactgggaaaccatttaaagaggaagtgttattagtattaaaaaatctgtcattttgaaatttctttttaaaaattacattaatttcttccctggtggtaatgccattgtattttcagtaggttttttttttagtcctgatactttttgtatatctagctagcaattttaatggatgtgcttaactcatgaaaatccagattttaaaacatgataagttaataggtgatagttattttataagaacatttgccatgagtttatttaaagaatgagagcttctttgtgcattttcatcaagtgcattctcctcaggaatatatctccttgaaaagaaaaaatggggtgtatttgcagtaggtttattgatagtcgaataggaagaaacagcatttgagaagtgtggagaaaagatcttcctgattactacagagacctcctaaagtggggccagactgcttgaacagaaagtttggaagcaattgtgtgaggtgtgctgcatttgttttactaattcgacttgatttttgtaaatacacctgttcatttgggtttgaggatttaattgcataaagactctttatttagctaaagcgtcttgtcctcatggcttttcccagaagtttgtgttataaatgttaatatattaaaagtgcttttaaatgatttattattagcatcttaaaaaaatcctacactaaatattaaagtagtctttattatttcaggtgaaggcaaagggaaacagtacgagttgcaaggtagggggtaaatggaaaggaagaaaaaggaaagacaggagatgaagggaaagattgagtcccatcattcttgaagacacattgttcatggcttcaataaccctggcacagccctctgaagaaagtgtagttatcctcttctttctgcaaggaggcagagatgctgtgaacctctcttgaagttacaggatcacttaggtagtaagtggcaaagcccactagagccctaaccctgtttgatactggtgagttcacctgctatcattaaggtgtaacctgacagcaatgtaaaagacaaaaatcccccttcactgaactccaaatacagttactgtctgtcctcaggatctctttatttttttcttctccttttcatggttcaaggagagatcccttttaatctcttcccttccagcaaagcttcctttcactttctacctgaagtcaaaaacttgaggccagcttagttcagagctcctctgggcttgcttatctcccagcctttgtggactccttcttgtccatttgtctttgtaatgacttcttcctgtcgaacctccctgctgaagggagacttcttactaatttctcttattttccctgcttgcttgctttgagattattttcttatctcttgttttcaggccaggaatttcttcctcctgccagcttttttgtgaatcctttttaacctctggcccaagtcttgatccctaaagcagtaaaagcctatggaggcctggtatggtttttctgtacagtttttcctccctcccttctttttctacccttctttctgaaaaaacaacagaaacaaaaaaaacccaaaaaccctctgatacttgattttgtatcaataatcaatatacattaatataaaatttattaatataaattgacttaatatacacaatactgagttttttccaggcttttgtggaagctccccactgcagtccagaatgctccgtgaccaggtcctaggattctttcccttggtgccattgtgactgctcccttattttataccttcagctctgtccagttctcttcttggcctggctgagctgggctctgcacctcatgggagtggacatgaatcctgaacacaccatgtgggtgtactgggttgtccccaaccttaatgtgaaggcaagtttagagaagaatgcatgatgagtgggcttgcatgcctccctgatggccatatgggagcatgaccacaccacagggttagtccttacctggtgggagccactgggagcagaggagtgctaggtatcgcatggcatatttaagatagtttgtgtccagccatgacatttcaagtgctcattaactgcatgtggttagtagctactgtataaggcaatgtagttttatagacagtagcacagctgtatgcaagagatgggcctagaaagacaggtaacacttaactagacagatttgggggaaaatacattcctcaatgaaagcaaagtttaaacaaggttgaaataatttatttaaaaaaaaaaatagctggctgggtgcagtggctcacgcctgtaatcccagtactttgggaggctgaggaaggtggatcgcttgagctcaggagtttgagaccagcctgggcatcatggtaaatccctgtctttactaaacatacaaaaattagctgcgcatgatggcaagcagctgtagtcccagctaattgggaggctgaggcaggagaatcacttgaacccgggtggctgaggtggcagtgagccgagatcatgccactgcactcctccctgggcgacagagcgagacaagcaacagcaacaaaacaaaaataaaaacagctaatgaagttcttattatgtacctggtacattctgccattactgaaattaactgatgtcatcttcacaacaatcctttgaggtgattacaattattatttaatatgtccataataaatgacaggtttaggaatgtacatttgaattgtggttctgactgaaacattgggcagttgaggaagtacttgataaagtgattagtgccctttttaagtgtgagcaatttctagttgctaagtcagggtatcatttatgtatgaattaccttataggtaagtatactttacattcttttatgtaactcctaactatcaacctccagatatcacaaagtttacttgtgggtgattaaattgcttaagacaagagattgcccacccatacagaatttctattgcttctgccttccagagaacagtgggagcagcctggcctgcaggttgattgtcagattctgcctccctcccacctacttattcctccagagagacacatagcttagcctcctgtcacactctgtcattttcctggggctgcagagcaaagggctccctcaggttaattctgaagtcctgtgtatgctgaagtctgcttgaagaaggagagaagcttccatcttgcatatttcctaatactttatctttccttctgtaacaacagtgcacagattttacttcaggaatgtgtttttattcactcctgctgttatcctgtatactaaagtagtcctttgtcaatgtgctgatgtgctctagaaacatataaagagttttttttttaattggtttgttgactggacgtaaacactagtataacactaaatctaagtgcagagagtgggcagcctgattttgttcataatctcaggggaatcttttataatgggccaggaagcacgtgtctgtggtttctgcatagggcgtgttctgtggtgcccagccagctgtagtatgtcctgcgagatttggcctgcaggccacaatggtgggcttctgggaggaagaatcttccttagaagtcctgccctttgacactccttctgctgaagtgtcctgatctcagtggggctccctgattttctgttccggggtctatcagcactgggtctatcagtgctacccacgccgccgtgactgtgggtcactgagggtgacctgcgtgggtcccatgggctcagcctggccttcccaggtcctacaaggtcctccttactgtccgtccctgctcagtcaccaaagaatgacttttttgaaagtacaattccagagttaaatactggctaagtgtagaaaacaatactggaattcagtcttcacctccaccagtcctcatggtgagatgaagtgtttatgggtttctttgttgtaacctcaaaagtggaatgcatttcctggttggtgctgcttgccctccaggtgcttagtgagtgaagcttcatcttccagatttctctttgtggcttagggtatctgtatgattttcctgcttttgttttcagaggtgctaggctgtgctgatctctctggagtgattatggtgctttttgcctggtaagcccatccttatgtgtaaaaatcaggatttagatgtgaggcaaataaggtggtggtgattttgttttacagagagattttcactttgcaaacttttagaccttttcaaattctaatttgatttgatgtatttaaataacaagttatgtaaaaacattgaaatgacccattttacagaagtttggtttacaaacccattgtttgtgtaaggtaacatacctgaggccaggagcatgatacctttcctctagtcttgcccttgtccctcgctttgggctccagctacatcagagtaattgccatgctcacaaccccatacagtgagagcacagaataatggtctgggtacagtctggggccagacagcctgtgtttggactctatttttcttactacctgtgaatcttaacctctccatggctcagtttccccattcaaaaacaagtatatgttgatagaacgttttatagagtagcaagcattaaatgagttaatacagtgcatgaaacatagtgctcattaaatattacctcctgttattcattcagcatttatttctctaccattcttaagctattctcacattgtgcaatgcatttttgtcacatctgtctttttaaatattctgtatactaacagtcttattgctttcatgaagctgccctacaatttccagttgaggttctaatcttagctgtacattgggattacatgtggattttaaaaaatgccgatgcctgagtttttggcctgtgctagagccgcttgtagctgcttgtaagaattgactgttatagttccaggactttgtaccagacggtgaaagcattggtaacttgaaatcaactatgttgggaatatttgcactcgtaattggcaaatactaccacagctctctcttcaatctgtttgatgttctagtgatttgtttataagcctgtctctctcaataggtgttgaccattttggtggaatgtattagtttgccagggctgctgtaacaaagtgccaccaactgagggcttaagcaacagaaattcattatttcatagttctggaggatagaagtaaaaatatcaaagtatgaacagtattggctccttcttgaggactgtgaaggaaggatctgttccaggcctctccttgacttgtagacggccacctccttcttacgtctcttcatatcgtctttcctccatgcatgtctctgtgtccatgttttccctttttacgtggacaccggtcatattggattagggcccaccctgatggcctcactttaactctctgcaaagaccctatcttcaaataaagtcacattatatactgagggtgtggacttccacatttgaatgttatagggacataattcaactcataacatagggcgaggacattcttttccacctccctcctcagtccgtttgtgcctgtggtagttgcacagtaaagatttgtagatttgaaaaggaaataccttttggctgatgttatttgtatatacttttttattcattgagctatgaactccagagttagtatggtttaaaaaaactttttttgttgttttgttttggaaacagctccttcttgggaaaataagagttagtatttctagagaaaaatgttagtttagaaagagtagttattttaggctaaggcagacctgagcttgttaatgaacttgtggactcaaaaggcgtatgattgagtgaagtggtcttgattttgtgtcagtggctgacaaaaagcttttaatcatgcatgaaaaaaatgtttgtgatgaatttccactgatttgaaaatgtcttaatgttgctagtcctcttcaggattatgtaagactgtagagttcttagaagagtatggcctttcttgctttttctcaaaggcaaatataatgtcaggtaattttgctgttatgctattgaaaaaatacctcctgagtcacaggaagcataaattattttttaaagatttaccatgtgttaggatgattgtgtcatatattaaatatataatggatgacatttagactattatcatctcgaagcatgtaaatatagaatatactttttgaagttagttttcttcaaaacgagagatatttctcaccattgctttttgctgagtaaataccagaattagaatcttatgccaaaaatatatttggagtacacatttgcacaggaatttgtttttttccagactttttaatagaaaatctttaggtataaattacatacggcaaatataaaaagttttatttttaatcaattttaatcaggtgtaatttatatgcaataaaatttatacattttaagtgtatgagtcaatcaattttgacagatacacacatcaatataactaccacccaaattaagatctagaacatttcatcttcccaaaacgttctctttgcctttttgcagtggttttctccccacctccacctcccactccaagcaactactgttctgatttctgtcactataggatagtttagactgttttagaatttcacataagtggagtcagtacagtgcatacttttttgtgtccagctcgttttactcagcataatgcctatgcaattcacccatgttgttgagtgtatcagtagttcattcctttttctcactcagttgtattgcatcatatgcatataccaacatttgtttatttacttgctgaacatttgggtttccagcttttggctattttcattaaagttactaacatttgtgtactagtcttctcacagatctatattttcattttcttcacataattaggagtggaattgctggattatgtgggtaagtatatgttcactgtataagaaacagccaggccaggcacagtggttcacacctataatcccagcactttgggaggccaaggtgggaggactgcttgagcccagaagcttgagaccagcctgggcaacatagtgagaccctggctctaaaaaaaaaaacaaaaaaaccccaaaaagccagatgtggtggcacaagcctgtaggcctagctactcagaaggctgaggtgaaaggatggcttgagcccccgaggttgaggcttcagtgagccataattgtgcccctgcactccagcctgggtgacagaacaagaccctgtctcaaaaaaacaaaacaaaaaagtaacagctgaagtaggttttggagtagtagttaatttaccctcctctcagcagtgtgtgagagctgtagttgctccacattcttgctgactcttgtcagtcttttaaactttagctattatagttagtgtatggtgtcatgttttatttttaacttgctttttcttgatgactagtgatgttttcatgtgcctattggttattcatttatgtatctcttttgcccattttgagacttggattacttgtattttttagttataagaattctttatacattctgaataaaaatcctttgtcagttataggtattgtgaatatttactcccagtgtatggcctgccttttaattttcctgattatgaccttggaacaacagaaggttttaatttggtgaagtcagatgcattagtgtcttcttttatggttactagtgctttttgtatcttaagaaatctttgcctactccaacatcatgaacattttctcatattttattttagttctatagttttagcttttaattttaatatattaaatagttggatttaactttggggcatcatgatatgaggcagggattgaggttcctttttctttgtacgtttaccagttgtttccacactgtttatagaaaagacttttatatgcattgaattatgttgatgccaaaggcttcattttgtctttgtttttaattaatatttatttatttattttttttagagacagggtctcgctttttcgcccaggctggagtgcattggcacgatcatagctctctgcatccttgaactcctgggcccaagtgatcctctcagccctgcaagtagttggggtacagattttcttgtggagatggagtctcacttatgttgcccaagctggtctcaaactcctggacttgatcaaaggttttgttttgaatttgactttgaaaaatgacctagatttttatgttcttatattagatattttagactttgactttctaggatgtcatttaaaaatgtttttaggtctccctttttcttttttctttttttgagacacagtctctgtcacccaggctggagtgtggtggcaggatcttgattcacttcaacctccgcctcctgggttctagcgattttcctgcctcaccgtctcgaatagctgggattacaggcgcccactaccatgtctggctaatttttgtattttcagtagagacagggtttcaccatgttggccaggctggtctcaaactcctgacttcaactgatctaccctccttggcctcccaaagtgctgggattacaggtgtgagccatggcactggaccctctttttcttttttttcagaagttattgtatttatcacataatagaaataaagggtgggatgggagctctagaaatctaccatttcagcttcttccttagtagacccacattagcgatgaatataaaatagatatgtgtgtgtgtgtgtgtgtgtgtgtgtgtgtgtgtaccctgagctaatggaatttgtggaacatttggtaaagctcataaatattgcacaactggtacaatcttaagtaatcaattctaagtttttagggccgggtgcggtggtggcttacgcctgtaatcccagcactttgggaggccaaggtgggcggatcacgaggtcaggagatcgagaccatcctggctaacatggtgaaactccgtctctactaaaaatacaaaaaattagcctagcgcagtggcgggtgcctgtagtcccagctactccggaggctgaggcaggagaatggtgtgaacccgggaggcggagcttgcagtgagctgagatcacgtgagatcgcgccactgcactccagcctgggcgacagagtgaaactccgtctcaaaaaaagaaaaaaagagtttttaacaacttttgttaatttttcttatgtttaataataattatagataagcttttctttacctttggttttctcatatttgaggactgcaatttaaatgatcttcaggaacttcttttcttcttgtattttgtgaaatgaaatgcttttaaaggcatttcaggcatcagaggtagatgaggtggtattttgggcagtggcagttgtttctgaaatcacacattagtagcttttcctatcctttatcttctgttcccctggagtgaaaaaggtgctgttggaggcaaaatttgtggctactgaaaatattccttaatgctggtagcttcttgacttcgtgcctttcttacccaattacatctattctaaagctgtcccacttcttttcctttgagcacatgactactgctatctatctcctattcttaaccagcattaattacactgtgtattagatactgttttaaaggctttatgtttgttgaccgacttaatcctcataaacacccttgtgaggttgctgctgttattttattacgggttttatagatgaggagactgaggctcagagatgttaagtagcttgtctaggttatacaattactaagtggcaaaactggaagttgatacagacttcctggctctaaagcacactatgtcatacagcctctcaggaaaaacacagaagggagcagctattcccttccttcacctttacttttgactgcaaaaggggtaatattttatagcacaattaaaattattttggttaatattttatgaaatttctttcccttataatgcatattacagtctgaatttctctctggtggtaaagtttctgacaaagcatctgtgcttaaaacaaagcagctttatttatgaaggtatttctttacaaaccacagccctggtatccagcagaaagcatgggttgtctttacatgtggttattcttctgggaaagcatcttagaggaggtgagccttgacctgcttgttaactgagaatatgtgcacaggtctggggtatagtatgtgtagattcgtggtaaaaagacttgggattgtgaggggctgaaagattacgaaaggataggggttttaaaatattattactaaggagttctgtccttagaaaagatttctaggatcaagaaccaagagctggacgatgatgacaacaggcagaaatgagtggcttctctcagcccttgacttctctgccattccctcccccttcgagtgttcccctttcctttggtttccaagttgcacgctgatcctcttagtgtttttaacctcattgcagacagaagtactttcccatcaggtttgccaagacagactagaatttttttgttagaattttacctttaaaaacaaaaccaaaaccaaccattacaaaagaagcaaaggtataatcaaaagtgtagaaaaaactagaaaaaaagttttagaacaacacgagtttacctagtatagactttctgccttatggtaatacctcctgtctctcttagccttttgaacagcccagctctcattgtgctagccttgagtctgaggccccatggagttcccatagtggggaaattctcaatcctcccttgctcccaaacaggcctctcctttgcggataggtcctggtgtgtttcttcacctcaggcctctttaagcctgaagaagcgtgggccctacatctgcttttagttttcagtcccttgtggtaagttggctaaggccctttcgcctctgttggtaaggaggggttttttgggcctccagaacctcccacaggtgctgtgtcttcctgttggctcattccgaggaggactcaccagctgactgtcaaactgggtcttcctcaccttggttcactgttggccatgtggacttcagtaggggctgccatccttctaagaagctatgcgattgtgtctatttccttctctggacagcaggagacccctttttgaagacagcacattttctttttttcttcttttttttcttttttttgacatggtgtctcattctgttgcccaggctggagtacaatggtgtcatctcggctcactgcaacctccgcctcctgggttcaagcgattctcctgccttagccccctgagtggctgggactacaggcctgcaccaccatacccagctatttttgtatttttagtagagacagggtttcaccatgtgggccaggctcgtgttgaactcctgacctcaagtgatccacctgtctcggcctcccacagtgctgggattacaggtgtgagccaccacgcccggccagcactacactttctaatgagtttttattgaaaaaaattttagttgaaaatgaagctgttggctcgtaagtgaaaagcttgaaggcaggctggaatcaggcatggctggaattgggcatggctggttgtaggggctctgctctttcctctcctcctgtgatggctgcctcctggtgttccacaaggtggcaggatgctccagtgctctgtcctgactcccagcctccagggttctagtccagggaagaggaccagcatctccttctgggagctcctgtataaatcctgtaatccattttttctcttctttctcttttctaatatgccattttattttttaataagttgtatattttagttcaaaaaatggaaagtattttaaaaagattatgaggtaaagagtttcttccatcctgtcccttttactattataaaaacacccttcattgtcctgttttaatggtttttattcgaattttatttttcctggtaataagatttgatctcatactttctttttatttgtattcacctaatatatacctctaggcagttgttgtttttcagccatctttttaatttgtaacctttctgaattactttgttttggattgcactcctatttgtagcatagaattttggggtttttttcccctctgtgatccaatctgaatttaattttcttttaataggtgaatttagccctttaatatgtcagatatatttgatattagtttatactattttgtgttatattttctatttttatatcttttaaataatctttcacgatgtgatctgttttctttgcatcttttttttttgttggttttgtcctggtggttggttttagaattataatttcaaataatgcccttagtcttctaagaaagtggtggttgttccctactgtgagcactgataaaattaatgagtttcatagtaattctaatatggagatattaaagccaggttaccttgtctgtcctactcagtcaagaaccctgtttcattctgtcttcagaggagagaatgaattactcggcttggaactcatcagtgctattattaccaatgagttcactgtcagagggggccttgtaagttttcccagaggatactgtccacctttaacaaggctctttttgtctatgagtttctaaagtcggtatagatcatgcaattggtaagctgacatttgtttgttcacagttgaacattagttcagagtctctgttggtggtctgttatttgatgccagagagtcaccagttttatttccaagcagacattaaaagatattattggttctgaagttcccttgttttaatgtgggctcaacacttgctgagagagcatttagtttttcaaaagcaatatggtaggcaacagagaggcatgttacatgtgaaaaggatttcttttttttaaaattagaagctttaatttaaccgtctagcttggcatgccctgtgtaatgactgagagaccgagatgactgtcttgttgtgagtcccaccaacaaggacagaagggaggttgccaccttgggaggagcacatcttctgttcatgctcctctccattcaggaggcttcagccccacagcacaaatagcctctgtagcggtcaagggaatgtggttttataattttttagatctgggtcaattatataatcatagataacttaatttttttgatgcagtggtatttactgtccacctctaataaagcaggtgaatcatagactaccattggatacatgtctttggagcagatttccatccatttttactccagtcctatggtggctaccggtattgttcttgtcgcctgctattcttaagtctgcagtttgcctgtgactcaccccaggaaacctgttgaaaatgctcgctctcctctaacttcctgctgaattcagatttagcacctttcgggtgggaatctgtacttctttgcaggtgactctgatgccggtgtcccacagactacagtttgaggaaatcaagactgacagttctgcaaggtttattaccctttaatttttcaaaaaataccttcagcaacagagaggcatgttacatatgaaaaggttaaagtagaaattttcctaaaatctatgtgacagaattctggtaggatgctaggcatgtgtgcagaatttcaaatagactttttttttttttttttttttttgagatggagtctcactctgtcacccaggctagagtgtggtggtgcaatcttggctcactgtaacctccgcctcccgggttcaagcgattctcctgcctcagcctcccgagtagctaggattataggtgcccaccatcacactcggctcatttttgtatttttagtagagacagggtttcaccatgttggccaggtaggtctggaactcctgacctcaggtgatccgccctcctgagcctcccaaagtgctgagattacaggtatgagccaccacgtctggcccaaatagacttttgtttcagagatacagtgatttgaatttatcataacgttctttaattaagaaatccaggaaaatagagataggagattttataactttaaccagtttgaaaaaatatttatgtgaagatggtttaatatacagattgcagaacgatgaatttaacattcttgtaaagcttccaggaaagcctcaaggataagtgacaagtccatttttatcaaacttaatgggtttctaaatccttatctgcttatcaaacaaaattttaattagaactgtaattgagtaaccagctgcctcttgtgttcactctaggaacttgtctaaaaacattgtggagctcatgtaaggtcattcgtttttgagttgctaaataaactttattgcagacttctaaaaatccaggtattgaggaagtctacaggaagataaaaattgataagaactttgcagtagttagtccgatactctctctctctagtggattaaggtagaaaaatccttcttcagcaccacagatgggagaatatcctccctcttaggtttcttcctgaatcagcttatgcctgcctaggcttgtagtagaacagataaagcctttggacctagctactcttggtttgaatatctgttaatctgttatctcttcattactttggacattgtacttaatgtctcaagttcaatttactcatttttaaaatgggaataatgccgcccacagcaaggagagccgtagttctggaacttgtactcattcattcctttattcagcactactttataggttgagtacctgttttatactaggcactgttccaggcattgaatacagcagaaataacactgacaaaagttcccatcctcatggatcctagtgagcagagccatttcacaccaggtgatcggggaaagtttcactgagatgatgacttgaatggagacctgaggaaggtgagggagtcagatcaccataaaaaattactttttaacattattattatttttctttactattttctgcttaatcctactagaaagtaagctctatgacagtggtgggtggggggtggtatttgttttgttagagaattttagatgtgctctgttgtattagtttgttcttgcactgctataaagaactacctgagactgggtaatttataaagaaaagaggtttaattggttcagggttccataggctgcacaggaagcatggctggggaggcctcaggaaacttacagtcgtggcagaaggtgaaggggaagcaggcaagtcctacatggctggagcaggaggaagagagagggggaggtgccatacactttcaaacaaccagatctcatgagaactcactcactatcacaagaacagcaagggggaagtccactcccatgatccagtcacctcccaccaggtccctgctccagcactggggattacaatttgatacgagatttgggcagggacacaaattccaaccatatcatatatggaagcacttttcctgatcacagaaatggggagctattgaaggagtcagagggcaagtgcaatgtcttcatctttagtgctctctctggcagcagtgtggtacaagggcttgaggggtaacgtgcagtaggcactccataaatgtctgctaagcatttttaaaagtgatcattctgccattcactatgagccataagagtagctggtagaaatgcctgtgaatgtttaaaagcattatatagactctatttcagaattgtgttgactaataaaaaatgctagttttccctaccccacacctatctttcaactgctttatatttatttctttattagatagaaaattcctcagtaaacttttatttagagtaattcctctttatgatttttttgttctaaaggtcgattcttaaaagaaaacttgttgaagtgctctaaatggaagtctttttttttatttctctcctgtgtcttttatgatagtatctgacaactatcttttttttgtttttgcagagattgggttttgctctgttgccaggcttgtctcaaactcctggcctcaagcgatcctcctgccacagcctcctgagtagctgtgattacgggtgtgagccactgtgcctaacaccttttttgagaaacttatatttttttacatatttattcttgattcataatatttatacatatttatggggtacatgtgatattttcatatgtgtatacaatgtataattataaaatcaggtgtttaggatacctgtcacctcagacacaacatttctttatgtcagacatttaatatcttctagctattttgaaatatatgataaactattgataactgtagtcctaccctactgtgctatcaaacactagaacttattccttctatctaactgtatgcttgtacccattaaccagcttctcattacctccctccccaaagctctggtaaccattattctacctctatgagatcaacttttttagctcccacatttgagtgagaacatgtgatattcgtcttttggtacctggcttattttacctaacataatgacctcagttccatccatgttactgcaaaggacagggtttcattttttggggggggctgaatagtattccattgtgtgtatattccacattttcattatctgttcatccattgatggacacttaggctgagtccataacttggctgttgagaatagtgctgcagtaaatgtaagaatgcagatatctttttgacatactgagtttgtttcctttgaatgtatacccagtagtgagattgctggatcatgtaatagttctatttttattataaaaaattcttttaagagagggtgtcttgccctgtcacccaggctggaatgcgatggcataatcatagctcgttgcagcctggaactgcttggttcaagagatccttcccacctcagccgcctgagtagctgggactacaagtgcactccaccatgcccagctaatttatattattttttttagagacaggctatgttgcctaggctggtctcaaactcctggcctcaagctttagcttcccaagtagttgggtctataggtgtgagccatcctgcccagctagtaggtctattttaagttttttaaggaacctccatactattttctataagggctgtctcagtttacattcccaccaacagttatgtaagagttcacgcctctctgtgtcctgaccaacactttttgtctttgtgacaatagccattctaacaggaatgaggtaaatatgtcattgtggttttgatttgtattttcctgatgattaatgagagcattttttttttcatatattggccattctttcagggcctttgcccatttttaaatttggttatttgtgtttttggtattgggttgtttgagtttcctatatcaaaatacttctaaattcagcgtgatgatggaacattggtagttgcttatgagataaaacagactcttggattaaagtaaaaagtaaaagtttcagaagtaatttaattttcggagaagccagtaaaattggaatcatttgtgttttatttgaaaaaattaaaatatggtacaaatataagaatataatacagatatagaagaaggctgctgaaaccaccatctagtccaggatatagagttttggcagtcactctagaagctctctctgcctcctcactgtcatagccctcagaggaatcatgatcctgactttgtcattgttatcaccttcttaatttcctttgcagttttgtcacccaagtatgtatccttatggtttaattttgccagtttattttttaaatgtcttcaaaatttttaaaatttatatttttagagacaaaggtcttgctatgttgcgcaggtgagttgggaactcctgggctcaagtgatcccccttctcagctccctgagtagctgggactacaggtgcataccactgtgtctgactttttataaaaatacgttttaaacctctttatctacaggttccctctccatctctttttattcctatcctcacctttggttttttttttttttttttgaagaaactcagttgtttttcttgtggagttttccaaagtctggattttgctgattacatatccatagagtttaagatattcctctgtattttctgtaaattggtagttgaattgagaggcttaataaaattcaggttttttttttttcatagaagaggaagagaactttgtagattctattttttcattgggaggcatataattatctctctttttgtgaattgagtagccattgatactcagtagtgatgaacaagtcttgctttttaaagtatcattatgaacccaagggcctaatgtattttggcttcattgcagttgttattcttcccagtgctcaaaatggcccattattgggcaaagagagtctctccaagttgacctctgtgccattttgccatgatgctagtaatctttagtagcttttttgtgtaacaagttagtctaggatcatcttaaacattttcagtcccagacctggaattagtcatttctccagtaatccttccctagtttcttttagtaggaaatggtatttttttttttttttctgagacggagtcttactctgtcgccaggctggagtacagtggtgcgatctcggctcagtgcaacccccgcctcccaggttcaagcgattctcctgcctcagccgcctgaatagctgggactacaggcgcgtgccaccacacccagctaatttttatatttttagtagagatggggtttcatcgtgttggccaggaaggtctcaatctcttgacctcgtgatccacccacctcggcctcccaaagtgctgggattacaggcatgagccactgtacccggccaggaaatggtatttctaaaccacattctgtgcaactagggaggctatttattggataggtcaaactatattaagaactcattaaaaaatacttctgattcaaattcagggctaaagagtttttatttaactttttcagtctgacatctatatctccttttccccaccatgtcgacaatcctggttcttatgtaagtactctgattttatcattcaaatatcaggtatttaatttgctttatcccacattactgaatctatgttattaaaattatatattataaaatgccattgcatttaaaggtcttacgtttcttccccatttatttcacagttgtaatatatctgcatcatcagagcatatagccattaggtactataccttctttcttatagcctccattgagagtcttagttctccaaacaaatatgtattacatgctcaccaccaattcttatatccatgtctttctagtcattttggttgtctgaaatttattctgtagtatggttgttcttacaccttagtgtgcatcagaattacctggcaggcttgttaaagcgccgagtactgggcctcactggcaggttctctggctcagtacatgtgggatggggcctgagaatctgtgtttctaacaagtccccaggtggtggtgatgctactggtctggtgaccatactttgggtatagctctctgtggcctttatacatggaagattggctaagcttaaaattcctggcttacagtttatttctttgagtatcttaaatacattactctattgtctgtagggtaaaacattgcggttaaagtttggcaactctgtttttctttcttttataaacaacttgtcattttggctggaaataattttactagattacttactgtgatggtcattatgggttgatttccccaggtatgtgatgtgttttttaaatatacagtgtcaagtgatttttctgtttctttgctttgccctctttgccaactttgtaccttgggggcaccttttatacacgttttaggtcttctttgccaaccttttgtatttgttactttctttcaatctttcaaatctcctctttcatttctttttgactttgaaaaaaatttccccctttcatttcctgcttcttatctttattatctgtagtattgattcagttgtgtgccttctagactatcgttcattctgagaagttttccttttgtctctaattcctgagttctgcccgttgatttctgagtttttctaaatccaatttgttttcttaataatttttttaacttgttagggttttcatgttttatggagatatctaacatgattctgttgtctgtagagatgttattatgttttttctttttttttcttatcataactttggacaggatttgagttgggtccttttctattactcatttttatgcaaattcattttcccaaacttttagaagaggcatgggttcaaaatagcttttctgacttcacagttctggtagtgttttttaactccaagtattatttataaacagttcatttttaagtgtacagtttacacaactgtaagtgtaagtggtagttttacacaattttgtaaccactatcacagtcgagatgtggaagaatacttttaccctaaaactttccatgtgcttttgcagttggtcccctcccttcacatctggccctaggcaattattaattttccaccagtatattttaccttttacagaatttcaaatacaggatatcttacaatatatattaaaattttttggcttgatttctttcacaaaatatgattttttgaggttcattttgctgcatattgtcaaagtatttgaaaatgtgacagctcattttctcctggctctgttctgtagtacttttgtctttttaacaattaccctgttatccttttctccccattttagattctgttcataggagtttttcctcagggtaagatttgtcctaaaaaagtgctttgcatcactggttttgtgaattcatagggcctagagttctcaagccccttcaggctttactgtggactccttgtagtcactattatcaaatatacaaactgcactcccaatttcagctcctcaaaatgtcctactgtgctttccagtgagtacctcgttgctgttttgtgttgtttctgttttccgattgttagagttctgttgcttttgtctgcttcttctcacatggttgctgatagcatttgtatcttattgttcatcccacctgcttgcattttggggttcttaatatcttgagatgcagttatagtgtagtacatgttatctgtgggttttagtttggttattaaagtctctttttatggcaggatttagggagactgaaaaactatgcttgaatctaacaaaaaacaacaattatttcaataaaatattatatcaaggaaaatagcaaaaaattacaaatgtgtgttacattgataaaatgatacatttatttctacttttcataatattgagggagggagtgttctgcttttgtgacgaggtatagccatttgtgtttctgtgttttctgtatcttttacatatgtctaccacattactgtctgttgtcttagattgtaaactaagaaacagtgattgttgtgtggcatatgcccatgagaatttgtttaactgtttttgtgaagaaaaaaaatatataaactatagattttctgtcataaatccttctttctgaattttaacctaattgtaaagcaaaataggtaataaagtttcactattgtttatttattacaaggcattgtaattgaacttttaaatcaactcatacgatctccttgctcaggaaggaaaatcataaaaatagaaaaaagcttgctttattttggtgctggggatggtttcaagtcttttttcagttttatgtagagaccaagaaagtgttctgcatagggagccaaagaaaaaaatattgagaaactttctaaagtatcttaactcagttgtttatagtatagctttactttacagataacttttgatgttcttagatcattagatatacctacatcaatatacataagataagcttccaaaggaaatactctttgctttgggaatactctttcctatcatctactaattttcattatagcagcagtcttttatttgtataggtcagtggttctttaactttaatgtgcagtagagtcccctgatgctgggccgggccccacccaacacctgttcctgtttcagataaagaccagagagaggtatgtgtacgtatctaagagtgagcacaaccaaagctgtataaaaccttcatggaggaaattacagaacattactgttggatataatagacatgaatagaagaatataccagctttgataatgtgatacctctatttaagatgttatttctctctaaattaattcattacatatcaaattaaaataccaataagggctgggcgcaatggctcacgcccataatcccagcactttgggaggccgaggtgggcagatcgcttgagtccaggagtttgacaccagcctgggcaacatggcgaaaccctgtatctactaaaaatacaaaaaaattagctgggcgtggtaatgcctatctgtagtcctagctacttggggctgatgaaggaggattgcttcagcctgggaggtcgatgatgctgcaatgagccctggtccagcctaggcgacggagtgaaactctgtctaaaaataaataaataaataaataaataaataaataaataaagtaatcccagtaagtttcttgtgaagaccgaaggtaagtgaacctaaaattcacaaagaaaatcaaagggccaggagtagccaagacaatcttgaagagcaaggtagggaccttgccactttagatatagatgccaagccctagaaattaagagactgtggtcgtgatacagagatagacaaaaagaccagtggaacagcatggagaatccaaaaacatatatagaaatgcaatatgcagtgaaagtaacattataaatcatcagggacgtatggaatgctaattgctgctttgatcattaattatatggaaaatgaaattgtatttataacttcacactatccacaaagataaattctggtgaataaattcagaaagcagatcttaaatttattagaaaatataagaaataataaaatacttagctgctgttaaaatgtaaaaagcacatgtatcttcatgtataaatcttagaaatagtgtaacattgaggataaaatcaatttgtatggttatgataaagtaccactcatacaaaatgaaaagcatgaaatgatacagttttttataaaacatgaaaacatgcatggtaatatacatcacattcaagataatgtttgcttcttttattaatttttttttttaatttgagacgatgtttcactcttgctcaggctggagtgcagtggtgtgatcacagctcattgcagccttgactccctgggctcaagtgatcctcccacctcagccttccaagtagctgggactacaggcatgtgctaccgtgcctggctaatttttgtattttttgtagagagagccatgttgcccaggctggtcttaaactcctgagctcaggcagtcctcctgcctcggcctcccaaagtgctgggattacaggcattaagccaccgtgcccggccagcgtttccttctggaaatcgtagagggatgtgattagtgagggatatgtgcaggctacaactgtaactaaagttttatatttttaaataaaaatgttttaaagcaacatgtgacaaaacattaacaccaaatgaatatcaaacaacaaagaaatagttgaagaaattgtggcatctatatactatgaaatatttttcagccattaaaaagaaggagttgtagctaggtcatttttatggagggactttcaagaattattaagtgaagagaacaagacacagaaatatgtttataaaatcatctcagttttataatgtagtaatatataatgagcatatattatatatgcttgtgtatgaccaaaatatgaacatgaaaaaatatggaaagattcattctaggctgttaacatgagagataacagtcatgggagtgagatgataaagaaagaagagaaggaggacagaatagggagtcaaaaaacatagaaaaagaaaatgcattacccagcatgcatgctatgattttgtttatgtacttaggcaaatttttatacatatttttaggaggactgtagaatcactttaaagagtgagagttaacctaatttactatatttgactggagactgtgatagaaacagatttagcagaaagtccctcaaagaaagagttactcagtgctgtattctgttgctagattatttaaacaaataacgtaatcaaatcaaaatgatgcttttcagtttttctctcttcatatttagtaacataatggaccctaatttcaatgagtttttctttttaaataatgatagatataaaatactcacaatgtgctaggtgatataaaatagcagttaataaaaagtacttggccaggcgcagtggctcacgcctgtaatcccagcactttgggaggccgaggtgggcggatcacaatgtcaggagatcgagaccatcctggctaacacggtgaaaccccctctctactaaaaatacaaaaaattagctgggcgtgatggcgggcacctgtagcttcagctactcgggaggctgaggcaggagaatgatgtgaacccaggaggtggagcttgcagtgagctgagattgctgccactgcactccagcctgggcaacagagcgagactccatctcaaaaaaaaaaaaaaaaaaagataataaaaaaattaaaaagtactcattttaatattttatgaaatagagcattttggcagagaaactttagctctttctttctctctctttcttcaacttgggaaagaataaggaataaatctttatcttttttttttcctcttctggccaagacctaaataccagcatttcatgataatggataagttatctttgaaattttccttttttctttcagtgtgcaggatgacagaattcgagtcgaaaggatggataacatttattttgaatacagccatgctttccaggcagttacagagttttatgcaaaagatacagttgacatcaaaggtaaatattttccctgtatgtcctcaagttgaactgatttgaaatttggataaaggtattagtatgattctcaatttaatgatgactaggtagttattataaatatgtgggagaagaagagctcactgttgttgtgctcatcagaaacactattgtactgcagtcccagctactggttagactgaggtaggggaggatcgcctgagcccaggagttcgaggcagcaatgagctattatcatgccattgcagtccagccggggcaacaaagcgagatcctgtctgttaaaaaacaaaaagaaccattgcagcctcttttgaaattatgaccagctagtaagttgatggttttgacatattcatcagagtggaaggagttttgaccatctttcctttttgcttatctttaaagatggctcattagtatctttgtattttatagactgtttggatgataaatattctgatgaagactagcattttgaaaggttggttgccaaaattaaaacaccagaatctagtgacaggtcgaaatattttaggtaatcattatttgtctaattcacatgtccacaatcaggcattaatgtttactttcatttgtacctcacattcctgccagtccagcttatgttagggtccattttgtggatggtgaggtgaatagacattttccctcttggcataaacttggcttcactctaatcttcatcctactccatatggaggaaatttatctctgtcacatgctagagagtgttcatcatcagctccccatcactgctccatttaagcatcagtgtctagttagcatttccttgcatctaggcatcagtgtcttgttagcatgtctctttaatttcatgatgccttggtcaaataaagtgtctgagcgtgtatcccacttctttttatttttttctgtaaggtctcactctgtcacccaggccggagtacagtggtgcaatcttagcccactgcaacctctgtctcttggactcaagcagtcctcccacgtcagcctcccaagtagctgagactacaggcgtgcgccaccacacccagctaatttttgtattttttttgtagaggtggggttttgccatgttgcctaggctggtcttgaactcctgggctcaaacgatcctcccacctcagtctgccaaagttgctgggattacaggcatgagccactgcgcccagccaagtgtatcccacttctaacaccagtgttcagtattaccgagaggtcatcttatgttcaactaaagacctgataaatcttaagactaccatgacctatccgtggtaccagatttacttaaaagatatgggccagaaaacacaccttacaagcagagcatgtgttgctcttagtgggatagtcctcacagcagactttgtggcagtgcccgggagagtgtatgaaggaaggagactcacatcaagtgagcgtaagcgccaccctggcttagaagctccaggcccttgaggagcctgtatttcttgctgcagtctctacaaaagacacgccagttgacaaaagtcaacgcactaagggaaggccaaaactctgtagtcaggtatttataattcttctcagtccagatgtaatttactgatatttggtcatttttaccacaggcagtgctacttctaacacattgatacaccatctttgtcatgttttctggggaagaaagctagaaagttaaaagaaaatcaatttctcagtggaacggaaaggtgttgttagcacttcatttacactctggttttataaacacctatagttaaaattaataagatattttactgatttgtagagaacatcttgtaatatatgtttttttacttctaaaagtaattaatgcttattgcaagaaagtcaaacagtgtagtcgtatataaggaaaaaagtaaagtgcctgccctcaaacttgtcctctgcccttgcagcttatatgtcggaggggttatcattaacaatttggcatatatccttgtgtaaaactccacacatacacacataaacatacacatatagttctctgtatttgtttaacataactgggatttattcgttcagctaattttttgaatgcctattatatgccaggcattgggcatacaataaggaataaaacagacaaaaattcctgctcttttggagtttacattctaatggtgagagatgtacaataaagtaaactagtgtgttagaaggtgataagtgctatgaaaaaaataaggcaggggagtgggttgaacttttaaataggatggtaaaggaaggcctcactgagaaacagcacttgaacgaagatttgaatagagactgaaggagttaaggaaaagagccatatagacatatgaaggaacagtatttcaagcagagacaacagtaagtacaaaatatcttaagtaggagagtgcttggcatgtttaaggaatagcaagtagtctgtgtgctggaacagagtaactgatggggagaacattaggtgagctcagaaataaagaggagatggcaggcagtatagggtcactttaagggctttgacctctactcttaatgagttgggggatgttggaggacttttgagcaaaatagtctaatgatctgatatacattttaaaaagaattcctctggctgctctgttaagaataccctgtagggtgcaaggatgaagcagtgagaccagatggaaagctgttgcagtgtttgtggtgagacatgaaattgatcagacaacttttttccctcacttagcaacatgttatagatggccttccatatcagtgcagataattggaagtcattccatttagttggtacataataaccaggatttacccaactttatttaagtactacgctgttaatgtttatttaggtggtctctagtttttttttaatactccaaaagatgttttaagtcaccttctggtacacacatccttgacatgcagtttggagtatttctagacaaaggggatgggcattttacattttgaaaaaacaacctgttcttcaaaaaaggttcattccaccatcagaaaaatgccctttttttccatgccctgggtattagtaatgatttacatttttccaaaggtcaattttaggagatattgtccaaattattattttggtaaccattaagttttacttaaaatttgtgtttaataatgctaacaagttaatggttctgtttattacattttttaatttgattaatttaaaagaatttttataacaagttaatatattctgttttctaggttctcaaattatttctggcattgttaacttagagaagcctgtgatttgctctttggctgccatcataaaatacctcaaagaattcaacttggaaaagatgctctccaaacctgagtaagtgattcctccaaaattaaaaaaagggggagcttatattatgaacatttcttaaattgaatttggtagtactatacttagagaagcttgcctgctattgatagaatactagggtgcaaggatgagctgtttggtattgttgctgaagaatattaaaaatatattggctgggcacggtggctcatgcctgtaatcccagcactttgggaggccgaggcgggcagatcatgaggtcaggagatcgagaccatcctggctaacatggtgaaaccccgtctctactaaaaatacaaaaaattagccgggcgtggtggtgggcgcctgtagtcccagctactagggaggctgagacaggagaatggcgtgaacccagggaggtggagcctgcagtcagcccagatcccaccactgcactccagcctgggcgacagcgagactccgtcccaaaaaaaaaaaaaaaaatgtgtgtgtgtgtgtgtgtgtgtgtgtgtgtatatatatatatatatataaagaattctgtcaaataaattgtattcatgatagctatttgatatattatagttttgactacaaaactgtgctttatactaactggacccagaaatagtattaaaaagcattcataaaaatttaccacctttcttattcttggtttcagttcttatttcatagaccatgaagttagagataaaagggccagctgctaacacagctttttacaagagtgattaactgtggattttggaaatttaaaagctcacaattgacattctaggaaaatactagtttgataaccattggaatagaaaaaagtagtagggtactttccttgtctttttatattccgccttcaccagccccttgtctttgggtctgtcaagaatcaccctccattatattgatccagggtgcatcagctctgtcccattctgcacaagtgggaggggagataggtgctatctcagcaaaatgacagaatagaaattaactaggaaacaaggaggtggtgctggttcaaggttgctggagagagtcaaagaaaggcaggttccttggggttctttttgtaatgtctttgatgtgcgttctcccgtgtggtactagaacagagtatcatttctctggaagcaactttatcctatttaaaagcaatctaaatgcccatcagggatccttgtgctatattcatgcaatgtaatgttatatagcagtgaaaatgaatgaactagagctattaatatatgaccaatgcttaaaatttcatgaacagtatattaagccaaaaataaagttgctgaaggccacgtagtacataccattatatgaagttagaaacatgtgaaatcgtactctgtactgcttaagaatatatatgtagttagagaataagtgaagacatgcaggggagtgatagaaaattcagaagcagggtttcttccagggggaagaagggaaagtagtaaaggttggggatggacgtggcatagtggagttctaactgatgtttcatttctgaatgtgggtattgtattaatctatacattttttagtgtggccaaaatgttttattttaaaaagtgtcagcccggcattataccctcattggattctactttaagctccaaaaataaacttattaaagagatcaatctgtatggttggttgtgttggggctttgtaaaaaaaggggtgacaagatacctaccagtttgacttgttcatgatagggaccctgtaagtgaggtacaattagtgataaatagcttgcccattaagacttgtgtttgtgttcctgtatcaccaagcaaagaagtattaatgttgggataaggaaactaacttagaaatcaggccctgatgtgtttagaagcaaatgaatttggacctggaaagatgtgtcctcctcatatatatatatatatatttttttttttttctttttttttttttagatggagtcttgttctgttgcccaggctggagtatagtggtgcgatctcagctcactgcaacttccgcctcctgggttcaagcaattctcctgcctccacctcccaagtagctgggattacaggtgcacgccaccgcgcccagctaattttttgtatttttagtagagacagggtttcaccatgttggccaggctggtcttaaactcctggcctcaagtgatctgcccacttggcctcccaaagtgctgggattacaggtgtgagccaccgtgtccggcctgtcttcctcatatttaattcgaaataagaataataccaaacaataaaacaagatgtctatatatactgaaattaaaatagattcttttcaaattacctgaagtaacctcttgataaactgaagctgaactttttgcatctcataattgatggtggaggatggtcaggaaactggctctgctagtgacttagtgtatcatctaatctacctgttgggtacttccatggagccaaagccaaaagacataaagtgctctgctttgtatatattcccagcatccagcataagcccagcacctagtaggcttttattatatattattatatatagtattaatataggattaatgaaagaaggaaggaattcttcattctgtgagggtatatttcattggaaattgccaaaaggtcattggaaaccaagattaataaagatagtgatcaaactggtactctagttttgcttaaaaacgaaatgtggtgttcatgagtggcatgtaatttgaagatcattctaaaagagtaattctgtagtgcttatattttgcaaaaataatgttgcttcttaaggtgattactttggaaaaatgaatattctccttgtagatgaaaaattcagttgcattattttataaacatactttatgctgctgaagttttggacttttatttacaaagctatgttatcaaggggaaaataaatttcacttgagttgacttgtttagtaaatgctttcacaaacgttgctgcatatttcataaaaatcatgatatacgtttatttaaaggtccttgtgccattagaatagaattttagatagtttgagaaaatataccatttcagaaattattcttaaggatgatttaagtgaagttttgttaagacacacttgaggttctaaagttattttgagagtttaagtttgtttcaaagaaaaatagtgtaacaaaataaatagaatgtgagggatattatttattataacagaattaacctgatgcctaaatttatgaaattcagaggaatccactttttgttgttagaaatgaatgcttttgtcattttggatggtttttattaagattggagtggtcacaacttcaaaaagatattggaaattttaggaaagagtgagaaaatccacccaagataaactgtaaaaccttttttttaaaagaaaacttcttatgataacagaatgataacatgtggtgattacctttacttactagtgaaagaaatagcttaatatataagctactctcatgacatctaatggctagcagccagggatgctgctaaacatcctaaaatgcacaggatatttccctaaaaaacacattatttggctccaaatttcaacactccaaaaccaaacaaatatattacaggaaaagaaactacagaccagtatcttttgattataggcacaaaaatcctcaatgaaatataagtacatggaatcaggaatataaaaacgattgtactccatgactattggatttatttcgggtatactggcttggtttaaaaatctggaagccaatcaatgtaatctaccttatcaaaaactacatgatagtctcaatagacaggaaaaactctgcataagattcaacaccccttcatgataaaaaacgctcaaaaaactacaactaacgtggaactttcttgacctgacaaaggacatttatgaaaacctcacagacattaaacctgtctgttgttgttaagatgcagtattgctcagatcagtctctaagttcagtgcaatttgtatcaaatcccagctggcttccttggagaaattgacaagctgatcctaaaattcataggattcatatctctgtttcaaaacttactacaaagtgagtaatcaagacagtgtggagggtgggattaaaaaaagacagtgtggaattggcataagcacagacatgtgatcaatgtgatagaattcagagtctggaaataaacttatggtcatttgattactgacaggggtgttaagacaattcagtggagaaagaatagatttttttcaaacaaatggtgccaagataactgtctgtgcaagagaatgaagttggacccttacttcatgtcatatttgagtttggaagataaaatggaccaaagacctgatatgagttaacactgttatactcttagaagaaaacataggtgtaaatctttgtaaccttgaatgaggcaatgatttcttaactatgacatcaaaaacacaagtgagaaaagcaaaaatagatacattggacttcatcaaagtaaaagcttttattcttcaaagaacaccatcaagaaagtgaaaagacaatccactgaatagaagaatttttgtaaatcatatatccagtaagggacttgtatctagaatatatatatatatataaactcttacaagtcaatggtaaaaagataactcagaaaatggacaaatgatccatacaggtttttctccaaaggatatatgcaaacaaccaagaagcacgtgaaaatatgctcaacatcattaagcatcaggtaaattcaaatcaatgccacagttagataacacttcatactcactaggatggctataactaggaaaaaaaaaggtgttggctgggatgcagacaacttgaaatcctcatacattgccaataggactataaaatggtacagccattttggaaaacagtctggtagtacctcatgacattcactgtgtgatccagcaattccactagatgttacttaagacaaggaaaatatgatgtccacataaaaacttatacaaatgttcataagagcattagtcacaatagccaaaaagtagaaacaactctaatgtccatcaactgaagaatggatacctaaaatgtgttatatgcatacaatagaagatttttcaaccataaaaaggaatgaagtacagatacatgttgcaacatgatgaaccttgaaaatattatggtagttgaaagacatcagtcacaaaaagtctcgttttgtctgattccatttatatgaaatgtccagaataggcaaatccatagagagaaagtagattagtggttgcctagggctcttgggttgttggggggaatggagagtgattgctaatgagtatagagtttctttttggagtgatagtatctagaattacatggtggtgatggttggccaattttaatatactaaataccacttaattgcacactccaagtgggtgaattgcatagtgtgtgaattatatcaataaagttgatagacacatacacacttatcttttaaatgtcagtagtgctgagattgaaaaatctttgtctctgtctattttaattctgttcttaaggcaatatccttctgaggcttataaccaatgcctcatgtattttgaggtatttctactctggttggagagtgttccaagccctttgtgaactctggtcactgttcactactattttctggtagttatttccatggtcccacagaggtccctaaacgcctttgaggactggtacttggccaagagttgaggtgacccttcagcagatctctggagctgtatgtgcagctctgttatctggcattctgtctcacaaattctagtttccctgcgcccaccaaagaggcagtcatgttgtttacctcatttgtttttcctctctcagggtcacggttctgcaccaagtgttgtccaatacctgagaagttttccccctcatgtgttttgtccagttttcttattgtttatgattggaggacatttctcatgcagttacttttttatgaatgaaagcagaggtcaggtggcacaattgaacactgcacagaaagaagagaagagggaggctggagaaaaacattctatgaagtttaaaacatgattaccggccaggtgtggtggcttatgcctgtaatctcagcactttgggagggtgaggtgggcagatcacctgaggtcaggaattcgagaccagccttgccaacatggcgaaaccccgtctctactgaaaatacaaaaattagccgggcatggtggcaggtgcctgtaatcctagctacttgagaggctgaggcaggagaatggcatgaacctaggaggcggaggttccagtgagccaagatcatgccactgcactccagcctcggtgacagtgagacttcatctcaaaaaaaaaaaaaaaaaaaaaaagttgagcacagtggctcaacgcctgtaatcccagcgctttgggaggtcaaggccttcggattgcctgagatcaggagtccgagaccagcctgggtaacacgatgaaaccccatctctactaaaatacaaaaaaagcagccacactggtggcgggcacctgtagtcccagccactcactctggaggctgaggcaggagaattgcttgaacccaggaggtggaggttgcagtgagccgacatcgtaccactgcactcaagcctgggcgacagagcgagactccatctccaaaaaacaaaaccaaaaaagaacagaagagcgagatgtatgaagttagaaaaactgtcctaaaaattgcccgtgttctaaaacttcaggaaaattaatcttcacttaaaaattagcaatgggaaaagaaccaaattcaaatttcttacaaaattattatgagaaaaaagagaataaggagtaggatgtcattacagataatgtatacatgccagaaaatcatggtcacagattaaataaaaatgacaatctggctgggcgcagtggctcacgcctgtaatcccaacacttgtgggaggctgaggtgggcagatcacctgaggtcaggagttcaagaccagcctggccaacatggtgaaattccatctttccaaaaatacaaaaaattagctgggcatgatggcgggtgcctgtaatcccagctactcaggaggctgaggcgggagaattgcttgaaactgggaggcggaggttgcagtgagccgagatcgcgccattgcactccaacctgggtgactgagcgagactccgtccctcacccacccacccccctaaaaaagaaaaactactgttttaaaatgagctaaaagacactaagaaaatgatactagatgtgaaagaacataactaagaagtatgaaagattggaaatgaggtgataggatttaagacagaagtataaagaaaaagatcaatttaggactgaagcgtaaacttgaaagaacataatagcgaataaatgtaatacatatagttttagagtagaatttaaaaagagggatgtgcaaaaaattaacatagcaggcctaatcacaaagctttccttagaaaggccttcctgcaagcttggcccttgactggagtctgggaccttgaatttcgggagagttttcaccatttcgtgatgagagtggctcactgtgccttaactgtttgtgcacacagtgtggtttatgctgatcacctaccttcttggagctggaattttggtacatggtagggagatggtgcctatgggaccagtccggcatagaaaccatgggtgctgagtctctaatgagttccctggtggacagcatttcacacgtgttgttacaattcattgctggggaaatttaagtgcatcctgtgtgactccgcctggagaggattcttggatgcccggttccccctggactttgcctcaggcaccttttcctttgcctgattttgctttgcattctttcactgtagtaagtcatagctgttagtattactctatgtcgagtcctgtgtatataccatgagtcattgaacctggcagtggtcttgtagactcaacatacacctttcccattatttgcctttctaatgggcttattggcaggatttagaaatgcaaagttagtcatgttgtttaattacagatcaattataagtgaatctacaaccctgaagttttgtaatatagtacaatttatattttataaatcaaattaactgccaaaaagttagacaagtgatgaatttatgaactctgaaagctgtacacacagaaatgttttcagcaatagatttcatgtgttatatggtagtttttgtcattgtttccattttaaaatgatatttaaataagttctgtacccttgttgcctttgtctgtcttttttttaagcagggttagagtaatatggagttgatttctctgtccagcttttgacaaagatgtttccctcccactattgagggaaaaaaagcatctattgtatttttggtgtctgaaatattgataaaactattttcccatgttatatataagatttctatgcaggttcacaaagcatgaattctagccagatgttgttggtgagtttcatttcaaagcacatagaatttgtcttcttctacaatggtaaataatttagaattgcttgagtgtttcaggtcagtgatcggatactattggataccttaggatgctggtagatataacccttagttcaaaaatatatataattctaatggaaataggtgctaacagaaggaaattgcatttctattgggaaggaagactccaactccagaatacgtataaatttatacttataaatacttacgaaatatatgggaactccagaagcatggttagtccttgtagttgcttgataattattctagatgggaatcaatctgatttaagattgcccagtggttgatcttttattaaaatcaatgtagatatcagtttaaaaaaactcttagtgcatctgatttgaactttagattacttgtttagtaaggacaaaaagaaaaaacaaaaacacacacagcaaaaagaaaagacaaaaacacccataaccaaccaaataaaaaaccacacacacaacacattaatacttacgttaataccattgattaaaataacctatacctttgctctctaaaggtctggggttgtgagctaacttaaaaaccagcttggttgttcacagttactggtttccttttgatattgcagatatttggtaattatatgtagatgaaggctgtaagccttctaccccaccccctgtataccaggtagtgggttaattcaaactgaattctgccactcatttagatactttttagcaagcaggcacaaaaacagtcatgtaaactcttctctagctctatgaaattacaattctgtctttttggtattccgacagtaccttgtttcagtggttcacttgaggcatgtgcaacattataatagggacagttcacttttagttggagtcagggaacaaaccctgagataattggtagaacaggggatgctttcagaatccgaagcctaaaacaccatcccttagggtatggactgttggatttataggattattataccctgttcatatgagggaggaggcaactgggcagtatttctggacagcccacaaactgccataccaccgtgaaaaattatgtcttacacatctgttgttgacagaagataaaggcagtgagctgagatgcttttaggaaaggctgctagattgtggtttcttgattagtctcatgccaactgttatggcctggatgtttgtgcccttcaaaattcacatgttgaaacctaatgactactgtggatatattaagaaggggccttttactaagtgattaggttatgagggcagatcgtttgtaaatgggattaatgcccttatattaatagaaaagacttaaaggaactgtttgtccctcctccatgtgaagacacacagaaggtgccatctatggggactgagccctcactagacaccaaatctgctggcaccttgattttggacttgacagcctccagaactctgagcaataaacttctgtttacaaactgcccattctgaggtattctgttataacccaaataaacaaagatgccagctaagcaccgttctagagtcgacgtctgattagggcactaacatgttaactagtcacccctaggatggacttagttaaacctaattgtcagaacagcggaagtaaggactcatatctaaacacataggtaactggttagataccaactcagagcccaggctatcagccaaacttccaacttagatctttgaccatgaattcatgtgaactcttgtcagctacatagccaatcactgcctaattgtttcttcctgtaaataatgttttacattttataactgtctggctatttcacagacatttctggagctttgtgattcaaagggaaaaatataaacccaacctggttttccctaggaagatggcagatatttgtagaccctctactgtctgctaagctgtacaggtggtacaaaatgattgccttcagggagcttagatctattaaggagggtagaggcacaacataaattgctgtaattcaagacaaattaagttaactgctaccagagggagagaaagggctgaacacttgctatcctttcagttttggagttgcttcccgctgaaaatcattaacagattatcgttctttggaagctagatcaaacctgtcacagatacattacactaccaaaggacagcattgagttactaggcaacgttcctaatttgaggtaaagtatttctcttttccagggctttggggccttagtcaaaggagtcatctagaagtgaaggaatctctttttgggtactggtttttcgggctctgatattaggttctctaaagttctgggtgagggcttgttttcttaactcgggaaactggatgttacctaaatttcattatagctatgagaagggtggttaggtttatagcacaaacacttatgcctttcttttgttaaataatttagtgacctgctgttattttccttgcctttaaaaataagctctcaagcctgtaagggctgttgacagaaacatctaaggactggctgataaaggatattgaattactgcattagtactgcattgattagtacttcttaacacgaattggaattgtacatacatttattagtcatgctgtagctcattctcaaatctttttgaaatttattgaacttctaattttgttttggatagatactgagacaataaggagagtgtgaatgctttaactcagtttaaggaaataacagtgttttatacccactaaatttggccatggtaatgtgtgttttttttcttttctcttttttttttttttggagacggagtcacactctgtcacccgggctggagtgcagtggcacaatcttggctcactgcaacctccgcctcccgggttcaagcgattctcctgcctcagcctcctgagttgctgggactacaggcgtgcgccactacacccatctaatttttgtatttttagtagagacggggtttcatcatgttggttggccaggatggtctccatctcttgacctcgtgatccacccaccttggcctcccaaagtggtgggattacaggcgtgagccactgtgcctggccgcatgtgtgttgttaattacagagtaaataacacttgttgcatatgttagaatcttttttttttttttttgccgaggcgtagtctcactctgttgcccaggttggagtgcagtggcgtgatctcagctcactgcaatctccgcctccctggttcaagtgattcttgtgcttcagcctcccgagtacctgggactacaggttcgtgccaccatgcctggctaatttttatgttttttagtagagacgaggttttgccgtgttggccaggctggtttcgaactcctcacctcaggtgatccgcctgcctcagcctcccaaagtgctgggattacaggtgtgagccactgcacctggcctagaatcttgattaaaagtatttatcaagatgatctcatgctaaagaataaggaggacagttttaagtatcttgacatatttttctagctgattacacagcttttcatgaagatgtggctactgtgcttggctaatgataaaagaccatgtttggttctattcctagagcaaaaccaaaacaaaatgttgttaccattacttccctttcctgttcttgttttttttttgttagagtaactatctttgtcttgcatcaatctacttaacagcaccagcgttaatggactacaacagcctgatgaattttcattttgctccttttgtttgattttctatcagaatgctaatttttgccataatgtagctggcatgtttctagttcctgaattagttttttatttctttatgcacttacatctaggctaattatatttgattcttttacaggaattttaaacagctatcaagtaaaatggaatttatgacaattaatggaacaacattaaggaatctggaaatcctacagaatcaggtcaggcaaatacaagggctagttgattataaatcgttttgggaaaaacttctgagtaaggcagcagtctgtttttagaggtacaggtgaaaatatagtgtctttagctgactgcagtattaattgataactgtagctctttttggagaatgaactgtacataatatttctctgggttttttggggggaatgatggagctgccctttttaatgactgaggggcatgcttatcctgacaatttctgtaacatcatttctatatcatgtagttttttggaaaggcatcatcactgaaaatatgaagcggattttttttgtctacttggttatatttttctatacacctttagctttttcttgaaatgtttgcagtcttatttaattattcaggttataggtttctgggatattcagtttgactgtaagatgcataacatttcagtttgcaaactttctttttttttttttcttctttgagacagagtctcgctctgttgcccaggctgggttgagtgaagtgatgcgatattggctcactgcaacctctgcctcccaggttcaagcaattctcctgcctcagcctcctaagtagctgggattacaggcacctgccaccacgcctggctaatttttgtatttttagtagagacagggtttcgccatattggccaggctggtctcgaactgttgacctcaggtgatccacctgcctcggcctcccaaaatcctaggattacaggcgtaagcaaacgcacctggcctcagttcacaaactttcattgtttatttgtcctttgttgatgaattaggaagataacggggagattaaacttattgctttcatttattaaattatcacttgggaagatgagacattatattataaaattaatgttatcctaacaaagtaatagagataaaaagcaaccccacgtcatttgattaagtactggagaatcatctgaaccatctgagtcaaaggagttaaaactcttcagaaatatttattactattgcaaattaaagtaaacactgaatttattctcctgactcctgaatctgcatattattaactagtttctctcagtttcttcctgttccagtctgttctagtatgctgaattcagatgtatttttgttcagtaacatttttatcttgtcatcatccaaaagctgagaatctgtcctgccggtctgtctcgtcaactctgtagccatctccatgataggaaataagtagtaggaataaagagacatttctcggctgaaggagtgctgatagcctgcagccagccctggcattgtaagcgttccctgcttctgccgcatcttccctgttcaaatcctactacaacagagtcagttctgaaatcaaattcctaaggcagaaatcatctggaatcaaaatacccttcaaaattccttcctttattggaccttgcaccattttagaagccgaagctgagattaacatcttctgcttgtctttgtacttcaacttcacccccaccgcccctcgcccacctttccaaggagcaatggaaagaggtgcagggtaggagttgggtgtcagcaagaacaaggatataataggacacgtatctgtccctcctctcttgtctgagcctgcttctccaggggtgtcagggaattggcctcctcacgggaccctttaccccagtcaggccagtcaagctgtggtctcaggagcagtgctgctgctgatctgaactgccctccttagcctgtccagccatcctcagaggaacctttgtgaccttgtaccttctctgtgctctctccattgaactcctgaggcctgagagcttatgtcacaccttttctagttgattcctggcaggtggcattgtatcctaattacgagtctttttccaacttggctataagcaccctgagggtgggaccatgtccttgctatgttcagcacataggaggtactctggaagtagctacttacagaggagaaggaaaaaagaaaggattaaaaaaacccggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtggcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaacccaactcaagtggaaacagccattttaggtctcaagatttaaatgtctcagtgggctttgtactactgtgaaaccttggttaaaattaattatgtctagttaattgtgatttttttttaaggacccaaattttaagtggcaaaagcaaacttttctaaggatttagtaaaacaaactaaaataaaatccttcctgggtaaatacctagagtgcagtgcaagttcatgtctatctccagcaccttgttcagtgttgtcatgagagcattggtttataaaatggtaactgtgaaataccaaaggaaaattaagtcatcttcctatgttgtatttcccaaggtaggaaagtatgcaattatattttaaagatgcttagataaagcatctttatcatttcaaaagaatttctgaataatttattctttggtaaccaaaaactataaacgatcccttttctgtgtaaaatgtcagtacttcattctgtatgtatgtattcatctgtcaaacattaaatgaacacctgttatgagccacattgtgctaggtatatatgacatttagaatcggggtatatgaaataacaatttggcacaaataattgtctagttaataaaacttgttttctggtctttcttagactgatatgaaaaccaaaggaagtttgctgtgggttttagaccacactaaaacttcatttgggagacggaagttaaagaagtgggtgacccagccactccttaaattaaggtaaaaggaattctttttggggtgtttaatctgaaattataaaattttgaaattaaaggcattttaaaaccaaggttaccattgtttttaagaacacagttttaaattggagaacattttattttagaactgagcaatagactggctctctagtattacaaggatttttttcctcattctcgtgaatgagcctgcctgcagattggcagacatagggcgttgtcccaggaaagtgaggatagatgccttttgtggagggttttgaaggctagactgaggagttgatagccagagggagttcattcagtgattctgagcatggggctgatatcatcagagctgggcttgtgtgtaggaggggactaagtggtagtagtggtgggatcaagttagcaagttcatggagaggtgcccaggacctgagctacagcagtaatagcaaggagtccaaaagaggggttaggtgtgaaatgcttagaagagtagagtgagtaaagttggagctccctaagggaagatacttgaatccagtgcctaacatacagtgatttccaaggttgtctgcacatcggaatcacctgggatgcttcacaaaatactcatgcctgtgtccagcccccatagattgtgatttaattggtctccagcatgaccagggagttgagatttaaattttacccagatgattctgatatgcagataaatttggagattctgacctagaacagtgcctggcacttagtagaagcccagttaatgtttattgaatgaaaattgttatttattgcacactttctatttactggtgtttaatactcaaaatcaccttctgagataggttcttgaaatgaggaaacagattcagagagcttcactaacttgcttagtgtttcatagctggtagagataaatataagatttaaaaccagcattgactccagagaccttagcaggaacaagccattatcctgaatagttatacctctggctagaccagagtgaatatggtgtgatggtgaagagaaccgctatgtgttggctctgtcagctgagtgagtcactcccactaatcctcagtgttctcacctttgacatggtggaacacctcatcacagcattgctgtaaggaataaaattttgagctctttatctcacaccacacagtatgctaggagctttatgagcattgtctcttttaaactgcacagcagcctcactaagcagatgctgttattagccctgtgttactctgtgattaataaatagtcactattttcaataatggattgcagatgttaatgttggtcataggcttgaagacactgttatgggttttgctgttgttttcttctttttcttttgcaagtttttttttttacaatgccaactttaaaaggtcactaaagttaactggacaataatctaggcagacatcactttacaaaaaagagggaaagcccaaaatgccaccttctatagaaaacgcacagtacagttttattcagagcaaagaaaaaagaaacttgatcatactatgagaaactcagccataggtttggaatccgtattcacaccacacattcactgaggacaatattctgctcatacgattgatttgctactgcatttcactgctgtttgtctgatattaacaattttaaacagagcagggcagctagtatttggaacaatccttacagtgtgacggcgtcaaggacgtttcacttctgttcacaccgctggttcgcttggcatacctgggtttcctcttcttcagtaaagtcatttttgatattggaagtcttgcgaatcttctcaggacttttctccttgattgtattggcaacagtcttgtgtgtaacatcaagcaaacctttgatgtctaagtagtttgcaggcagaagtagtacaaaaagtattccttgatcgactttcaggaattgttggtcctaaggagggatctcctctgttcgttttctttgttcgcatcatcctcgggaggaggacggccatttttgtggtgggtacaccaccaaatgaccttttaaaaatattgctgcattaactttggtagaggagctgggtcgttatctccatcatccattctcatatcttccaacatggtcttgatagtcacagattgtttggcaatttccacatcaaatatctccgcatcaaaactcagcatcttaattgacggcatggtgtttgagcttaaggagaccactggccagaggctcatgagagcagggcgacatcagcaaagaagaggaaggcagaggacaaggacactcaagacatggtttggatgatgataattaccaaatcttttcagatttagtgggtcactccgatttcttttcttagccataaagaccttaagacatgggaaactgatgaggtaaagaagaaatcctgaaaatggaaatatcttctttagttcagcattctaatgaaataagcagaccttgtagagcagacgcagacaagatggctttctgtggacaacagtgtaagggatgcagcattgtggctgctggaaaggctgcctaaacatctactacaattcttactgtgtttttgcttacatgttacagcagaaacagactcactagcagacttttccatgtaaattaaaattcttcatttccaatgttaaatttcctttttttttgtgtacccaggattaatttgagataaatctagtagaccatgttgtctgttgttaggcgccgaatcatgtatctctggggatcctaccttcccagaaaggcagagagaaaatatgccaggcattcaacactgatgttttcaagtatgaacttttcactgacctaacactgatgttagccaaaaacaaacacacgaaccttttctttgcccttttattttaggtcatggtttttaaacttttatactcctaatctattaaaatctatttcaaaagaattccagtttaattttaatggcacttgcaacgtattccaaacaaatacctggagagaatctgctgattagtcagtggctcagctatataattagtcatgtaccacatgacaacattttggtccttggggattgcatatacagaggtgttttctatgtttagaaatgtttagacacacaaatacttaccattgtgttacagtagcctacagtatttagtagagtaacatgctgtctgggttttagcgtaggagcagtatactgtaccatatagcctaggtgtgcagtgggctgtactatctaattttatgtaactatatgctctgtaatgtccacagaatgacaaaattgtctaacgatgcattttccagaatgtatccccatcattaagtgaggcatgatggtgttgttgtttatactgacataagtgccttactgatcacatcagtggctcatccagacaaatattctgtctctgacattgactgccaaaggttagtttagggtctggttttcttctacagtgagatcgtagaacaaataatggatgacgaggggatttagcaaaataatgcagatctccccaggttctgcaagatcccattgtttgtcagtcatccatgaattctcctaaatcccttaagctcctctttgtatttttatcttgttctagctcttaagggcaaacacacagttcataagtctaggaccaggcattcaagtttcagaagactttccactcccgtcaccttttattctataaaatggtctctttggtgcaaaattttaatagtgacttttagaaagtaaaaatgatttttactttacttattgactgattcaaagagttcacttagattattgaggctggattttactgtactgatatcacattagcttttataaatagattattttttcttatgtgttctcacctgtagtttttatcagttctgctaattttaggcaagaagattcttcagtgtagttgttttttaaataaatgcatgtcacattggcatgccattattcttaaggccttttaaaattagattatatcgaattaattttttttgaggttctgtctttggacttctttcagttgatatagtcttgtcaattttttatttacacacacacacacacacacacacacacacacacacacacacccatatgtatgtcattggttttgtcaaaaagcctgaaaatgcaaattctgcttgtaaatattggtagaggagaaaaaaagaaaaccgtgagatgagtctgtgttccagactcattggtgggttatgtgggatgagtctctaaaatggtgagttaagcaaaataattaatttccaaggcagatttgtttatcttagaggtattccactttcagtagcatactatatactttaaaaattaaaagaaatttagtttctttcatgagtacctctttcttctacctgtactttacattttttaattaaaaaaatttgtaaagttttatctttaattgacaaataattgtatatatttgtattagggttctgtagagggagagaactaataggatagatgtatataaggagtattgacttacatgatcacaaggtgaagtcccactgtaggctgtctgcacgctgaggggcaaggaagccagtctgaatcccaaaacctcaaaagtagggaagccaacagtgcagccttcagtttgtcgccaaagggcagagagtccctggcaaaccactggtgaaggtccaagagtccaaaagttgaagaactgagagtctgatgttcaagggcaggaagcatccagcacaggagaaagatggaggcctcaagactcagccagtctagtccttccatgtttctctgcctgcttttatcatagccacactggcagctgattagatggtgcccaccagattgagtgtgagtctgcctctcctagcccactgactaaatgttaatctcctttggcaataccctcacagatacacccaggaacaatactttgcatccttccacccaatcaagttgacattcagtattaaccatcacaatattcatggggtacaatgtgatatttcattacatatatacattatagaatgatcaaatcaagctaattaatatatctatcacctcaaacatttatcatttttttttgttgagaacatttaaaaccctcttttagctattttgacacacatacaatgcattaactatagtcaccgtactatgcaatagatcaccagaacttgttcttgtctaaccaaaactttgcaccagttgaccagcatctctcttttccccatctaccctctcccctagcctctgatgaccaccaatctgatctctacttctatgagtttgactttatttgattttacatataagtgagatgatgtggtatttctctgtctgtgcctggcttatttcactttgcattatgtcctctaggttcatccatattgtcaaatgatagaatttactgcttttttttttaaggctgaatagtattccagagtgtgtgtgtgtgtgtgtgtgtgtgtgtgtgtgtcacatttaaaaaatctattcatctattggtggacactttggttgtttccatatcttgataattgtgaataatgtggcagtgaacatagggagtacagatatttcttcaacatactgatttcaattcctttggatatatacccagaaatggaattgctggatcatatggtaattctatttttagttttttgaggaactagcatactgttttacaaagtgactgtactgatttataataccaccaacagtggacaagggttcccttttctccacatctttacttgttatctttcatcttttttaataaaaactaatctgaaaggagtgaggtgacctattgtggttttaatttgcgtttctctgattagagatgttgagcattgtttcatttatctattggccatttgtatatcttttgggaatcgtctattcagaccttttgcccatttttaaatagggttatttgttttcttgttattgagtagtttgagttccctgtatatttggtatattagccccttatccagtgtttgatttgcagatattttctcctagtccctgggttgtctgtttactctgttcattgtttcctttgctgtgcagatttttagtttgatgcaatcccattcgtctgttcttgcttttgttgtctatagtttggttcctgagcatcccaaggctttttctcaagtctttgcacttgttagtctttgtacttcgtggtctctctacgtagaatattcttctgtttctctttaatctttacagggttaactgcttgtacttgaggtctcaacttaaaacgttgtgttaatatcttcggagaggttttatttgacctcctaatctaaattatgttccttgtatcactcattgatagcatatagggtttaatcatgattgttacctatgtttatttaatatgcatggggctcttacattatctgtacaaggggtcttcagaaagttcatgtaaaatgcatattatgaaaaaactttgcatagatttcaaaaaattttggcaccaaaataaactcatactaacttgttagagcatgtctcaataggatgtagtttgaggcattaacagggataagatatcagtttgaaaagagcttctatcagaacaacatgaattctgctaaaaattaaagcgagaacaaacaccatatttatggtgaagcttgggtggaagagtggtgacatcattaatgctttatgaaaagtttcatgagacctcggaataaacaccacacatctacaactatctgattttcgacaaacccgatacaaacaagcaatggggaaaggattctctatgtgataaattttgctgggaaaactagctagctggagactaaaagtccaagatcaaggaatccttctgaggcctatcagggagaatctgttctggtcctctctcctacctgctggtggtgtgctggcaccctttggcgttccttggcttgtagatgtagctccttgatctctgccttcatggttacatggtatgcttgctgtatgtatgtcccttcacacagtgttttttaataaggacatggtcatattggattaggggtctacccttactgcagaatgacctcatcttaataattccatctacaataaccttatttccaaataagataacattttgaggtagagggataaggacttcagcatatctttttaggggtacacaattcaacccaaaacaaataggcccattatttccagattttcttccttttggcacacatagactgattatacccatctctttactagaaacaagtgttttgattattatttaaatgttttgctcatctattcaacgtctgatgtgaggttgtaaataaccattgaattttgtaaaattgccaatcttgtgcaattttgtgtttgtagtacagttctctgaaaagttattctcttatctttgacaaatatcctggacagtatctgtccaggtgaaggtatgtatgcaaagtgttacattaattttagagatgaaaaagaaacatttatatatatatttaaaaataaaggaaaatgcctaggaagaaagaagcagaggtctgaatctgagattcgaagaaagaaaagtagccaaggtggaatgggagaagagctgaggtctaagaggtaaggtgtgttactctgggaacatgtctttgtataggacaagcagaggacttaaagctctgagggatcaagggagtagaaagaaaatgtcagtctagtgaactaatctctaactgtgctttattttttatctgtatttttttcagctatctttagagatagttattctgttttagagataagaataactaagtctcagtttttccaaggtcatccagccaagcacataggggaccttttgaaagcatagttttggagttaatgatacttcagcttgagttctgattcccttttgtcactttggagaagttatgaatttgtatatacctcagtttcttcacctgtaaaatgggaattaactacctacctcattgtggtgttgtgaggaccaaatgagacagtatatgtaaaaggattagtgtggttcctcatagcaattttttggtcaagaaggtagccatggtctttagaataccaaaaaattggaagcagtgtaattattagtagggaaagggaaaataaattgtctggttatatattggaatattatacagcagttaaaatgaatgacttaagtctatgtgtatcaacatggataaatctcagaaaagcaatgttataaaagaacacataaatgatatcactaatttaaattttgtcacacacaatatcctgtttaggggttcaaacagaagtggtgttttcttgtcacataggcagtcaagacaataataacttctgggaaatgagaaaagggttagagatacaggtaggctggtgttttacatgtatttgcaatatttaatttttaaaaaattatacagaaaatacacacacatgaattttttataatgtactgctatttgaccttcactaccatcataatcaggtgaaaatgagacccatgcacatctgtctagaaagcccatgttgaacttgagagcatctgttttccagcacatcttgcattagaaagacagaagacagccatcagatgaccaaggcttccagggatggcagggggaaggctgggtgcttgcactgtcagtttctaggatctgcccaggtcatttcttttcctgaatctggtacttgcctgtgttttcttttgcctgtagctaccgtcaggaatgtagggagactttaggaggattactggtgagtaggtagagtcttttatgggggcctactctcaaaataatataaccatgaacaattgaggaatgtttttttgtggtcccttttatttatgctctaaacttgactagttctgggaattgaggaatctcaacctcacgttctgattgactaagtaaatgctaatgtgttcgttaacacaaaaggcaatgcattggttagggaagctagctgttaacacaaagaccccaaaaagtctaatggctctaatgttgtgaaagttaatttcttctttttttttctttgcataaacaatccatggcctttccacattggggggtggggtgagactctcatcacataggcagttaggaaccccagaggctcttcagttttaaacgtgtagcttccaacgtcatcttgagaactgatattcagcagtggaaggagaaagaacagggaggatatacatttatggcttttatgtgaggcaggccttgcattggcacatacccttctgcctaaatctgattataagcagaatgcattccgatggtcacagcttactgcgggggctagcaaatgtctgcttgtttttcaaggaataggaagaaatgtttagtgaatacctagcagtctgttgccagagatggtttttgttgtttcaattccattgtacattcttcttagcatttaaaaaattatttgaacttttgaacaggcaatatcttcacatactttaaaagtttgaaaatctgaaaagttacacagtaaaatgtttgcttatcattcctgccccacatctactcagatcccactaggtaatcatggttattactttatcatgtatacttccagaaaccttttgtttaaaaaagcaaatatgaattttatatatatatatatgaaatctcttcctcccttattacatagatggagccataatatacccagtactttgtacttggctgttttcccttagtagtataagatagttattttaaattttgtattattcagtctcagtgacaaggtggcgttcccagcgtcagggaatttctaatctaatctggtcaaggtataatctactagtaaggaggaagagatacaagtagtggaagcttttgtactaaaatcaaatacttacctgttactcactctataactcaataccacatttagagcaaatgagtaatacctttataagtcaaattagatttttagaaaactgctttaggaaattaggcatgctaagataattcttggcatttaaatcacataattaagggaatagaaaatggtttgtgttaggaaatagatctttgactacatttttgcatgactttctgatgtactaagtacattttagtggtcaatgttctctacattaaatggcttttgttttggtaaacccatatgtttggagtattaatggttgtatttctaatttgttaccctggcccaaatgatgaagtaatagaatgttgcatatttccttccacttaacatttaatttgtgttaatgaaaccaaatgtcacttttaactctggaacttctaaaatgaactacaccgggaagccctctgtattctttgtggtttcccatgttccatgagccagcaaccgggtgttcacttgcagtgactctggtttactcagcccctggggatgcattactgctcggaaatgggaagggagagtagcaggtggtgcgtaattgagagctgtgtttgattgggactgacctggtgcccctttcctctgccggtttgaatgagagtttaaaggaggaactgctgctgctaagaacaaaatgaacccgagtgcctcttactgtttgtcccgactgtcagtgcatagggattaactaacatccaggaacttttagctggcctctgctttgttcttcaacattcggaccttcagtgagctctagacctgcacaaacgacctgcagcaaatggcagctttcatttgggctgaggaagaggaatattggagagaatgaggagaaggaaataaatatctttcctttttggcccttcctgctttatctttctccatctttatgcctttattaatgaggattttccaaatatcggtcttcaaaaatgccataagaagacttcattttctgtggttttaatgtcataaaatatctccttatgtgaaataactagatatgctggatcaagcataacaaacatccctttaggacattgctgaatctgtatttaaaacataagggaagaactgagggaacagatggaaaaaggaactggaaatggaagtgaattgactgctgcagctgccctctgggctcctgcagatcttggtaatcaaaaggattggggttcaactgccttgtgggagacaggagacagggtcttgggtccatttaagttagagataccatagtaacgtgagacactcaaaggactgtggtctcagtagagaggtgacaaatacgtcttgacctgttcttgcctgaggaaaacgtttctaagaattcttaaccacaggccctccctcatagattttcagtttcaatttatactctgtgtggtctggcaatttccaagctgtgaaacttatttaaaacagtctgatggtactcacataaatcaccaagttaaaaaaatacaaaatagaataaaaaatatgagcatggaaaataaatactatcaaaagggctcagattgatttaaaaaggaaacacagacaattctttaagactgaatggactaaagaactcattcatgtaaccaaaaaccatttctgccacaaaaactattgaaattaaaaaaagaatgacttaaataagaatggatcttatactccaaaaagaaagaaagaaaagaaaacaacaacaacaaagcaggatatgggttaaacaagaatagaggaaataactgaaatgcaagataatacctgaagaaattacctagaatgcagcacagggtggcaatgtcaggccttcagtgtttcttctctggatttttgaaacagctttctaactggtattcctgacactgttcttatgtgcatccagactattagccttggatcccagctcctgtgatcacattttcaaaccttcaccctccattttccactaatcttttatagacaatagctaatcttttactcaatagctacccccaggaaatcctccctgatcctaaaactgcatttgttcgttaggtgctcctggcctgtgttcccattgtacctagatcataacccagttataatcttattacattgttatcattaatgctttttaaaaagttttactattcatcactagagtgtaaattgtttgtagactagcaaagctctgttaacaattatagccctaatgtctaccactttgtacaattagtactttgtaagcactcagtaattgttcattgaatgtaagaatgaatggtgtatgtgaaaggtgaagctatataggtctaatgatgcttagatcctaggaaagggcctatggttcatgtttctgacaggagattatttaggtagttcatttagccatttcacatgaccaatgtgttaatgtctgaatttaatctactcgttctgtgctgtcttaaaagtcaaacttttcagtaaaacgaaaccaaacaaaaaatacacccctagcagtttgtatttcagctccccacccccaccagacaactttttttaaacattttatgttggtaggtacatagtaggtctatatattaagggtatatgagatatttgttgcaggcatacaatgtataataatcatatcagggtaaatggggtatccatcaccccaagcatttatcatttctttgtgttacagatattcccattatactcttctagttatttttaaatgtacaataaattgttggctgtagtcaccctgttgcactctcaaatactagatcttattcaatatatctaactatacaaaattatcttaagtttgaattatagaggcattttcacagtagcaaccagtaggtactgactccatcactgacaatagctataggtcacactctgtgtttctgagtgacagccacacatggtagatactcatgtcaccacctagtttatcttcaaatgtgaaggactccagtgacactcacatttagtcctttcatctttggtagtaaagatgaatctttgtcatccccaggacctcttctttttgtttgtttggtatatggaatgaaatgactcaggtgccttctttcagttaatttaagttgtatagtaagatcaaccgtagaatactatcagtcatcttggaataatatctttatcatcatccaattgatgatgcttcttccagttttgtttcctgttgctatcactccatctgtcattaattgcactaagataataattctctattgtgtggcctgacatactgttttattacaattatttggaaggtcttgttactactgcacattaaaaaacaattctaaggtatgtgaattgtttaatatttaaaaatgtagtcattcttgcttatttccattctgatcttcgtacaggagttgaagatggaattatacctaaccgcagtgatgagaaatttgtggtgaacagtgtcacataccctttcactctctccctgcccatttagacctccataattattaatagttacattgtgctttctcaatgcaacctactgtccagtctcagcacagcgagtacttcagatcattactacttgtcaggtttagcactcaagatcccaggactagcttttcttgtataattcccacttgttgttcactttgcacaaaatacctgtttacatatctatgccctaaggtttgtccatacatagttatttctgagctcatattttggatgctatttatccctcttccatgctgttctttgtagtgtctactacacaaaatttgtaacgatgtggtaacagtaaacatttatgagtggttgtcatgatgtagcaggtactgtgttaagtacctgacatttattatttcattgaattcttgtactaacaccaagagttagggctcattgctcttctcattttataggtggagaaactaggacaaggctaaataattggtaaatggcagagcctgggtttgaatcaaggccacctgacttctgagcccaagttggtaacctctgaggtagtccttaaagaaggttgggttaaaaccaaactgattgatagtgaacatactgcttttgcctgtgttggcactagactaaaataaaaaccttttcctttatgttttcccagattccaaaccaacttggcctaacctttcaagtctctaagaaatttatagttttatatctattaaaaaaatcttctggtagacttcataaatatgacttagatttttattaaacttttttgctcgtatctttctgtatctcagaaaacctttaatttttgagacagtagctatttgtgtaggctgtcttatatgttcacagatggcattattttatcagtcctcaaaccatctgtagcatcaacttagtctattccaattggtgtcatctttcatttatgcaggagtgagttattaaagtaaaactttatatttgtataacattttgggtaaatgttagagtaaaacattggtttattttatcacaacaatcctttgcaaagaaaatttattttttccagctcatcttgatttactttatatgtagtcttcagaatgaaattgaatcgaataactgtttattgagcacaaattgttatcctgaaatgtagggataagaaatgacccctgtgttcactgaatttatagtcttgtaggaaagacagtgaagtagtaaattcccattgaagaagaaatacaattatgattaccattatgagaagggaaaagacggtagtatgggaaatgatagtaaagggattaagtctggtctagtgaatctagaaaggcctttcagaggaagagagggtaggagttcgccagacgaagtgtagctgatgggtggtagggaagaggaaaataaccttctaggcaaagtaagcagcaaatgagaaagcctccatgtcagagagcttggagtaactaagtcattgaaagatatgcagtctgactggaacttagagtaggaggaagagagtgacacatgatctcaggggagacccaagagctaaacaggcatcagttgttttttaggacaattaaagattctggatttgaacctaagattaatagcaagtcacagatgagtttaaagcagaggtgtgacatgaacagatttgggctttaggaaaaccactcaggctgcagtgtggagaatgagttggaaaaaggaatggaagtggggaggaaagttaggaggctgtttcaatataatttggacttagactatagtagtggctgtagaggtggagagtggtggatggattacagagtccaccctgctgagaatggaagagccagcccgtgtgtgtacaaagctctgtcttgctctcctgcatcgtactaacaaatggtccttctgcatgcaagagtatgagccagagaaaaatggaacaaaaatgaggcctgaagttagtatagaagctctgtattatgaaaaggcatgatctcacaggtagttaaggataataaagacaaaagcactcactaaatcgaaagtcctcagtctgattgtaatctagccaggatcctgatctaagatttgcttttcatatcagtgtgtatgatgtcaacagaattttgagagacaccaagtttattcagtggctgatgcctcctttcccccaaaacatcagttcattctttcatccacttgtttatttattcattcattcatttacaaacactttaaatccttactgaggacttactactcaccagacatgtttacttatcttagtttttaatactacagatggtcattatacctagtgtgggcctttgatgtttataggtacttcatggaccacatctcattgatgatacatttagtccatcagatttccgttttaagttgagtcatcacttaaggtgtagccgttggtaaaatcccgcagcactgatctcctatgtatctgaatgtcatatcctctgcactttctattgctactccccaatctttggtcagggtcaatatgtttaatttaattcattcaaacagttggtcagttcagccatcaccaccaccactaggtcgtcttgttggtcattgtttaactattatattagccaaggtaatgcaagctatcagcaaacaaattctccgtctaagtggcttaaatacattagaagtttatttcttgctaatataagttcaattggtaacagatccgggaatggtggattttctgctccactgtgggctcaggctgatggagttaccatgaggctcacaagcttgcctagctggcaaaggggattaggagaatgtgaaagcttattcaggaagtttttatgggccagggctagaggtggcttacatcattcccacccatgcttcagaactgaggtacatggccatacctaactacaggggagactgggaaatgtagtctttgtgtttgcttggtgagcctgtctttgtcaaacccagctagtgaatttccttgtatgatacctgctctttgattcagataataataagaggcatggaaggaccagatatattgttgtaggactttttccttagttcagttaaagacagcgaggttgggggagggtggtcctcatcacacagccatgtaaaattaggcccgcagacaattcgaaggaggagaaaaatggaatttattgggcaaagagcaataaaaagggaaacaaagactctccaacaagacagaacgagaatcttgctagtatgcttcccgcctcacagactgtaatcccaggttccacccaggaggaggaggggccaggctcctccctgctgccaaaggcgtgaacttctgtgtctccaccccagtgcaccctcctctcaatgcatacgcccattggagttttgtcagggagtccttcccacatgactatctcagtatgaaggaggagtttcctttgtgcctaataagtggctgtgtcacattcctgggcattagagtgggaaatgtctatattctgaattcctaacatatctgattattgctattactcttttctcacagggaaataaatgcccggcttgatgctgtatcggaagttctccattcagaatctagtgtgtttggtcagatagaaaatcatctacgtaaattgcccgacatagagaggggactctgtagcatttatcacaaaaaagtaagtgtgatagaaatctattaaagctgacagtgttcttcagcttgaggacactatatattaaaagaaaacttttgagagctctattattattttattttgtaaaatcttacaaatagcatgcgagagtagctgaatcctcagaaattttaatagtacaaattagagttattccaatttttccattgtagaaaataaagttttctcatgtgccttaactacagcaacatagaggcccttctgttataatatagggtattctcctgtttcatcctgaaagtacagactattatcaaaataggaaatttatgtagacttgttattttagaaaaaaaaaaccttatttcttttgatcttagaacaacttattgtttcttaaactatggaaaaatctgctagtataacatctgtggtggtagttagtatgcaaacaagcttggatattgaaggtgagtaaaggattattttgatttttatcacttaagctttacagtttgagtcatagcaaaaatgagtcattttccacggttagggaaataatttaggttatcttcaaaatatgcctaaaattaaaaaaattattaatatttttaaatgataaaacactataaactatggtgttttactttttgcagaagtcattcacataccttatactctttgttccttatcaaaactttatgacattgagaagttactatttttattaccttcttactaataagaaattatatctaatgctatatatgtgtgtgtatatatatatgtatatatataaaatgctgcaaccacttgaattaccttggctaatatgatgatgctcagaggtttagtaacttgctagtaacagaatctgtatttagacccaggattcttgactgtgttttcattggctgtgtcttttggatgctatcatgtttgatgtagttatcttgactgccattttttttttctggttgccacttttcataagcaaattttatttttcctccaaatgtaactccttgccaatttaataattttactgtgtaaccatttttatgtgcctaaatttttattttattttgttttattttgttttattttattttattttaattttttattttattttatgttatgttatgttatgttatgttatgttatgttatgttattttatgttattttattttattttatttttgagacagacttttactctcgtcacccaggctggagtgcaatggcgtgatctcggctcactgcaacctctacctcccaggtttaatcgattcttctgtctcagcctcctgagtagctggggttacaggcacccgccactatgcctggctaatttttgtatttttagcagagatggggtttcaccacattggccaggctggtatcgaactcctgacctcaggtgatccacccgcctcggcctcccaaagtgctgggattacaggcatgagccactgcgcccagccaatatgcctaaattttagttgtgaccaatttttcattagtgtttctatatttttcatccccttttacccccacagagttttactagaatgataagtactgcttctaagaatacttgaggtgcccaagaggacttacgtaactgttttacatgcctcagctaaatttgaaaacaatgcacaagccagaactggaaatactgatcctggggagaaagatatatgagttggttatggggccggggagcctattgcatcattattgggtacaccatgttattgttttgctggcaatagcagaagctgtgctgatagtcgcaagttttatggtagacctttttgaagttgcaatgtgggtgccaaaccatttgttgtttttatccttggctcagagcctgaaaattgatgcatattaaccttctttaaacaacagatctccaggcaccttgccttaactacttcaaaggattcactgacagatgtcagagatttgaaaacagaagcaaagctgaaaatctttcagtggctactcaaatgcacaaagtcaaagtgtccatggcatcaagatggcagcatcagttcatggggctgtgatttctattccaccttcctgcctttttgtaaactttactttgatgtttgtattgcacagggtttgtgtatttataaaagtttcaaaactctagtaaagtcagaatctaattcatttaaaaagtggccggtatgcagtgcaagaatgacttattttggaatttcaaaatatagtttactaacggaacttataactcacttggaagccattccttgttgctgttttagtgtttgtttacacaagaatgtacctaaagattagtttgaagggtgaagagtagaaatgatctggtaacaaaccaacttcaggaaagctgaatgctttaaaccaatgttttatagattagttggctggctctgtgtacacaccatcaaacatatgtctgttctttattattagattactctaaataagcttctactgtgtacaccacatagtgggtgatgtcctgggtacagattgtgccaattatgtgaaattcataaaatgagaaggaacactggatgttgtgggaagtggttagcataggctgtatggttttgtggaacgtgccctggaatatgtaccaataggtgtttttatggtgataatgatagaggatctcaagtgagctgattctggtataaaatagacatttcttcttcttctttttttttttgaaacaagatctcactgtgtcacccatgctggaatgcagtggtgcgaccacagctcactacagcttcagcctccagccttctgagtagttgggacaacaggcacgtgccaccatgcccagctatttttttttttttttttgcatttttttgtagagacaaggtgttgccatgttgcccaggctggtctccagctcctgggttcaagagatcctcccaccttggactcccagtgtgttgggattacgggtgtgagccactgtgcttagcctaaaataaacatttcttttgatggcaaaatgttaaattcaaatcctgtaaatagtgctagtcacaggaacccataataactttgctcaagaactgttttgtaagaaattcttaagtaactgccgaggttggtgaatacatttaaaggataatcgcacttagcaaatgttgaggagagtgttttcagaatttcctaggtgaaaatctttttttagctaagcaggaataagcccacagctgcatgttcagtgtggcacttaagctggggtccttcccatcctgtgtccagtgaggccctgccaccatacttgtgggtctgtgctcaagctctcccagtgagacagctgctgccagaagtagggctgaactcctggagagtgacttcaggagcagccacttacccatcctcagctttcttgtagcttcttttgagttcttttgcttaagaaacttgagaacaacctgctgcctctggctttcaacatgattgtaaagcactactggttttcaccttgcttctgttgctgacttaactttacattgtgtctcagcttggaaaattaatcattttcttgggattacaataatcataagaggttaatattcaaaattatattgaaaatgtttgtgtttgtttctttacttttgttaaaaggtatcattaattgactagtggccaaaaagcttccaggtttcacatttatttaaacagtccagcttcctgtatagggtggggagggggtctttctggagaaaagttgcctcatgatacacttagaattcaacatttgctcagttggacctaacttcttattttttttgcataattcaccctttgtggttagtaattacctttttgaatacgttcttagccttaatctatttcatatatactatctattatgtgccttattactttacccctaaattgttttctcatctcaagacagttcttttcagccaacattttgtcagttttattttcctgagctgtcttctagagccttctaacttgatccagtctggactggttgtccccatatctgttgtatagtactatcttagattccctttacttcccttgagttgaatcttttattttctatattccatgtcttcctcttcgtttatttcttcattttggtggagtatatatcctctagaaccttcctgagaaagcacgttggaagtaaatcttttgaaacattcatgtctgaaagtggtttttttgttgttgttattattgttactaccttcacatttgattggtagtttggattggtataaaattctaggttttagatgacttcattatctttacttcctcttctgttgaatttttcatttctactattatgctttaatttccaagaatttttgttttcttgtcctccaaatgttttttctttttaaaagtagcatcttgtttcatggttgtagtatcttctgtttcatggaagatattattaatatttttagaagttccctaacagggcagaatccatattggtacacaagtctttttggattcttgatgtaaattgtgtctccgttttccttaaggacagtttaaaattcagataccttgagtcttttaagtcaattactgtttatttgtttactttatagcttctaacatattattgctgttgtcttcttttctagtgtgtttttttccttttttttttttttttttttttttgagacggaatcttgctctgttgcccaggcaggagtgcagtggcacgatctcggctcactgcagtctccgccttccaggctcaagcgattctcctgcctcgccacctgagtcactgggatcacaggcgagcgccaccacacccagctaatttttgtatttttagtagagatggggtttcaccatgttggtagggctggtctcgaactcctgaccttgtgatctgcccgcctcagcctcccaaagtgctgggattacaggcgtgagtcactgcgtctggctggttttatgccgttttaaacaatctcttaactgtcgtttcaagatggagagaaattagatgcatgtgtttaactcactgtttaccagaagctatgatataaaaattattcatgttcatgttaaaaaaaaaactacagtagtatgcaggggtatgcagtaaagggtaaaaagtctccctctgccacccttccatacctactacccagaggtaaccagagtaagtcacatgtgttacctcctaaaatttttattgatatttagattttttatttatatagaataatgtatatcatttaaagaatacaaagaaagtgttaccatgtaaatacataaaaatatatacatatatggtatatgatataaacatactgtatatattcaatgtatgttgaaattatggagttctatactgatgcaaacagatcttaattttcttttagctgtttcgtagtactacactgcatgagtttttcccaataagatcccaattgatggacatttatttcttattcatctttttaaattataagcagcgctactatgaatattcagacacacatatttttcactatttgttagtctatttttagataaattatttaaagtggtgcttattcaaagggttatgtgcacttttttattacgaagacatgccaagttgtttttcaaaaaggttagtcctctgctaagagtatataaaagtgtcttttttttcttttacatcctgttacatggttattgtgaagcttttaaatctttggcgttccgataagtgaaaaatgctatcctatatttctaatttgcttgtctttaattatatatgaagataatcgtatacatacttgctgttctctttctatgagctgcatattcagtttgtttagccattgttctttggattattcatctttttcttgtcaatttgtaagagcctattatgtttgggagaattttgccttgtgtctgttatgccttacagatattatccttcacattttttaacttgtttaacctatttttgctatatggtttatgttattttaaaaatgaaaaaatactaaacaagtattggctttgttttccttgcctaaaattatttcctttatacctttaaaatattacatagtatttaacctcatttagaaaatatcagtgatattttatttcaactaactagttaatagaaaatttaaactttcctcaattctgattctaacttttaaaagtcactaattaaacttcattttcatgtatcttatgctatttcataaaaaatatttctattttcagtgttctacccaagagttcttcttgattgtcaaaactttatatcacctaaagtcagaatttcaagcaataatacctgctgttaattcccacattcagtcagacttgctccggaccgttattttagaaattcctgaactcctcagtccagtggagcattacttaaagatactcaatgaacaagctgccaagtaagtaccagaccctgaattcttccttttcaccagtcagtataattcagtgcatttgccatttatttgtggattcttaatctttactagaataataatagaagttgcatgagtacatatataattagaaatgtgattggaccctaaaagtgttacattacagctggaatacttgctacctaaaatttaggcagtttaccatctaggacagatatagtactcccccacatatcagatgatggaaaggtaaaacacaggcaaagccaagcattagtagtttattaaccccaaaatgagtgtcagatatcttgtactcatttcctatatttccagagatgtctttatatttagaatctgtaaaagcaaagttatcctttaaaaggtagttataacatattgcacaaaacattctatgtaaatgaaataggatttgacatttacgtttgtctttgttttctgcataggcaaacaacaaataatttatctcttggttttaccatgggaatcatgaagttaaaaagcagaaatgattttagggtaattttgaccatcctcagagaagttaaaaaacaaatccataagtgcttagtgacaattggaaccacatttttctgacttccagtgctttcctcttttatcacactatgaaaaataagcgataactgctgtaattaataaacttcgaatatgtatttgcatgttttgattttttagagttggggataaaactgaattatttaaagacctttctgacttccctttaataaaaaagaggaaggatgaaattcaaggtgttattgacgagatccgaatgcatttgcaagaaatacgaaaaatactaaaaaatccttctgcacaatatgtgacagtatcaggacaggaggtaatgtcaagcttacttttattttctattagttttactctagtagaaaagctattttaaaatgtaaatagaaatctgaggataggatatgtattatcttttcaaattttctgttttattccttggaaatatgttgtaataacttgttttgataagagttattttaatgatagtgttttattagtctcttgttaaagtaatgcaacttaatgttatatgtatattagcgttatctgttgaaattatattatagaaaatctcaattactatgaataacaacttatagaattcatttgttctaaatccaggaaagagaagttagtctttgatccctaccttgcagatgatgaaatgatacaaagcctgtgttgattggctcatacagtgattaaacggtggggcttcctcctaaagttaagagtatagctgctaaaaaaaacaagtctagagtgaaaaactacagttagtgagtcttccataaaattatggtactgtttagaatatgtttcttgggggtgtgtacttctgtttaaagtttgatagtaatgtctgaatgagaaccagaaaaggaagaagtatgccttttaaatatggttgtgcttttcagtcctattctgggtcttgaggcatgctactcctatatcttatgtttaataaaatatgaagattcaaactgagggagtttgagaaattctgttttattaaaataccaaattaggaaacttatggttaacttctatagaatgagcattttattcaggattttcaaaaaatagatatttttccggtggggaagaacttaatttcaaatcaaatttttaaacatttacattgttttgtgtgttttgccaaaagattgttgaatgtatagttatttgaaataagaagctctacattaattgagaatgttcattaaagtgtttattagtcttgtgttatttcatagatttacccattaagtcaacctgtcttctgaactaaaattattaagatattatactcagcagacattcacaatgccacatagagctctatataacagaaaaatgatttgacaatatttatacttatgtttattgtctgaacagacaaataccaaatatttaattgtaactcttgtttttgctatgcagtcatgaccttgcaaagtgaaaactggcctaaaggccactattctggctattggtttaaaatcagatgatcaacactgctttagttactttaataaaagatatgtagtagaaaagtggctgccttttctactacatttttttttttttttttacagtggagaaagtaagtgtaagtgccaattctaccatttacatgctatacgaccatggaagagttacctctgttgtaagactattatggagaccaattaagttaaaatacatgaaagtgctttttaatcataaagtgctatgcttatactactcatataataacaataatagtaatacagttaccatttatcaagtacttgttaaagtctagaatggtggtaggtgcctacatatattatttaattcttataacaatgcccaaaagggtcattccagtttgttggaaagaaaaccaaggtttggagtagttagataagttacccaaggtccgaagcacaaatccagcccacttctgccagactctagtctttctattatattaatatcagtatttcattccatttattaattccaaatattaacacaaagattctcaacaccatggattttatctgacaaaatctagatattttagagctcatagtattcaaaataaaataaagtttaagtcttggaaagacggtcctggattcatttggcagtttttgagtaaaaatgagagaaaattatcaggaattcataagagatagtagactggttattcattatgagtgtggcattgaggtttaaaaagtacagcatggagatcaactaattgtattaaaaattattaggaagatcagttatcttttatctttactaggttaagttgatgaatttgaggaacaaagtttcttcgttattgatagtaggatggattcttgttggtttttaataatcttctctaggattttagtagaatgttaatacaaaattgctttcatagaaccttttgaaaaaaataattctattcattggaacaccaaaggaattctaaatattcaaaattgttttaatcaaattctgttttaaaaacgactacagtggctcacacctgtaatcccaacactttgggaagccaaggcaggaggatcgcttgagctccggagttcaagacctgcttgggcaacatagcgagacaccatccctaaaatataaaattagccaggcatagtggaatgtgtctatgctccctgctactcgggagactaaggtagagaatcacttgagcctgacaggctgaagttgctgtgacctgtgatcatgccactgtactccagcctgggcaacagagagaaaccctgtctcaaaaaaaaaaaaaaaggactaatgctattctcaaattatttagaggtacttaaaggactaggaacagactccatcaaatatgattatctctgagaagtgagggaggcagggtggaaaacccttattttacatttattggtgcttttttatgcctttctgttctgacattttatttctatacatatgtcttttgtaataaccttaaaagacccattatagcagccccatgtgagccacgtgatggtatgtggatcttgttatttttactaaaattagataaatgtgccagtctgtaaatccagtgttattttgacaacattcatttttcacctctgttcccagcttttatatactcattagaatactaaagccttattgtatgattccttattgtctctatgtaaatattggcttagaagaaattaatgaaagcagaaactttatatttttatgtaataatgtacatacattattatgtattatgtaatgaacgtatgtatgaatgtttgtgtgtatgtatgaaagtatgtatgtatgtaatgaaagcagaagtttacatagtttactgcttctgttgcagtctctatcatattttatgaatatataccaattatctcttaaccttgaatgaaatgtggaatggaaatggggcaatgtttacattgggggcagtactgataagtattattattattactaagggaaaaagaaaaatattggaaaaaatctttagaaagggttttattaattgacagcatgcagcatatccaaatacctgtttactggtttaaaatgtggaaaataatctgttacatctgagtactttttacttagatttaaaatatagtaaaacatccttaaattattaagagaatgaaattgggggattggaggaatgggttaagtgtggtgctggagaaaacagcagtttctggagtgagtaagagtttcggcaagcctagcaacgttgccagcccagtgataccacaggctatatagattgaataacaatatctggcatttaactaagacagaattgggtcccaggagaagaatatgagagattgcttataatgaatcaaggcagactactcacatcaacacctaataaacaaagtcaggaactgtagaccaggaaaagttgctatgagagctttctaagattactggaatgtatgctatttttctatgttagttttcttttctttagtaataaaattcttaaaccaaaggcctacctgttcattcttagaatgtttgaaaaaaagaatagctagagaaaaatgttgtatcttattgtcagtatagaagagaagaaaagctagcagaagacaactctgaggaggaacccaggctgaaactctgaggattgctgagtgaggaaaagggaccctcaggatcagtccaaggaccagaccctgtctgaggatgtgaccagaggggtttaacttgtgccttcctgactctcgctgttttcccccctgcagtggcactgtattggctctgtgtatggtagcccgctgtagtgattgtgctcctagagtagaacttttgatacttacagattgaatagttgtggtccaaactgttcccaaggtgctccttgttcaaaatgtccaccatcccttagccagtaactcctgtggagctctgtgttagtcattatgcatctggatgtgtccttcccaaatatcagtgatccaatcagtctgttcctgaattttgctgtttgcctttagcatagctctttccagaattattttataaaaaggccaacatttcttttagtagaacactctaaaacagcagaattatttagcacagtttaaaagtgattttatctttcccattagtgatattttttgtggtttttcaaaagttactttttgtagccaaaggaggcttgttagactcttcactcttaactatttaagtgggtgtggcagatttgaaactgtagtaattctctataaatgagggcatcactagttcaaaacagttttctaatgatgaaattttttagattagccactaattcttaatataattaatgtaaaagctacagtgtttctattaatgggaaaaataaactcaagaaccatgttgatactgttattaatatgaacattataaatacctgaaggtacgtgcatataataaaactgataaatgtgaaaaagttctcatagctctctcaagatgacaaccacacagtttctgggttccattctgctcaaaatgggtttttataaatttatttaaatgaatcattgaattagttcttttgtttttctttttgttttttattaagacagattcttgctctgtcgtccaggctggagtgcagtggcacaatctcggctcactgcaacctccacctcctggattcaagtgattctcctgcctcagcttcccgagtagctgggattacaagtgcctgccaccacgcctggctaatttttgtattattagtagagatggggtttcaccatgttggccaggctggtcttaaactcctgacctcaggtaatctgtccgcctcagcctcccaaagtgctgggattacaggtgtgagccatcgcgcccggcctgaatttggttgcaataatacagaaatgcaagcacactgagaaaagataatacataactaaggctaaaaatgaatggtgtgatagaacttcacttgcttcctggctgatttcagagaaccttatttgcagagcacagttggatctataaatatattatgaatgtaaattaaaatgacaggagatattatctcaccccagttaaaatggcttttatccaaaagacaggcaataacaaatgttgatgaggatgtggagaaaagggaactcttgtacactgttggtgggaatgtaaattaatactaccactaccactgtggagaacagtttggaggtccctcaaaaaaaaaaaaaaaatagagctaccatatgatccagcaatcccactgctaggtatatatcccaaagaaaggtaattagtatattaaggagatatctgcactgcagtgtttattgcagcactattcacaacagctaagatttggaaacaaactaagtgtccatcaacagacaaatgggtaaagaagctgtagtatgtaatcacaacagagtactatacagccataaaaaagaatgagatcctgtaatttgcaacaacatggatggattatggaggtcattatgttaagggaaataagccaggtgcagaaagacaaactttgcgtgttgtcacttacttgtgggagctaaaaattaaaacagttgaactcacggagatacagaatagaatgatggttaccagaaactggtagtggtagtgggggtggaggggatgaggggatggttaatggatacaaaaaaaccagaaagaatgaataaaacctagtattgataacatggtaattataatcaataataatttaattgtacatttttaaataaaagagtataactggattatttgtagcacaaaagataaatgcttgaggagatggataccccatttaccctgatgtgattattacgcattgtatgtctgtatcaaactatctcatgtaaccaataaatatatacaactaccatgtacccacaaaaataaaaaaaagatactatggttcatataagtgaaaacttgaagaaaactctcatatgggaagaaacactttcttctctttatagttagggaagtcagtgctttcctgtgaagagacttttacaggatttcagttccttggataaaaactatctaaaaatcctctctgttcagaataggggaggatcatatctcagactggtgtaacatctagtaattgaatattttaaaattttatatacttagaaattcaatcttttatgagtagtagaattcttaagataagtgagtattaataaatgaaagaggtggttaatgaaaaagccatcagagtatacatataacaatattagaaacatgaaagcccaagtattacaaatgttttatgcaatacaaattgtactttgtcccaagtagtgaacccttaattaataatatttgtctgtattgacatatatacagtctgaaaaacaatactggacttatcttgagtgtttaacaatatataataaattgttataccacaatttggggaaagctttaaaatatataatggttacttatctaaatctctgtttatttgtatttgttttagtttatgatagaaataaagaactctgctgtatcttgtataccaactgattgggtaaaggttggaaggtaggtttaaaataaatttttttcttacaatgcattatgatgacatctgtatatctatgtgctactgggctcatcgtagccacattcttgaaattaaaagcaattctttttacttattttttctgatggaactttttttttttttggaggggatgtagtcttgctctgtcacccaggctggagtgtagtggtatgatctcagctcactgcaacctccgcctccctgattcaagggattcttgtgcctcagcctcccgagtagctgggaccacaggagtacactacaacccccggctaatttttgtatttttagtagagacggggtttcaccctgttggccaggctggtctcaaactcctgacctcaggtgattcacccacttcagcctcccaaagtgctgggattacaggcatgagccactgtgccctgccctttcttatggaacttttaaccaaggagatcattacttttaactctttatcattgattttaaaacatttttcaaaaaggtatcttatttttacacatttattttcttgttttgtaaattattgctttatttttatagcacagggtacacatggaagaaaagttgaggaaccttcaattgtaagattaatttagttgcttttacttcatggtgaatgctatgcctgacatttcttttaagaagctgcaatttcattttctacctcactgagctccacatttctttattcttaatgccttccttggcacataattattataattctttacatctttttttttgtaacccagatcatgaattgatgaaaataaattaatcaaaaacaaatttagagaaccacattgggactctgccttttctccttggttagatactaatctccaggagaggactcatttaaagacaaggtattagggaagtatatacagctgtgaatagtatcttttgtggaatatttattagtactgttatcaataagttgcacaaacatgagatgaaaatggtacatttgcctcagatggtagaagagggaccgtagctggtaatagtgtacagacattctgttttaaggatgaagggaaattttgacataatgtgtgaatgattgttactttattacatatataatatatataatacatatatacaaaaaatataatacaaatatatatatatatatattttttttttttcttttttttaagacagagtctcttttcgtcagccaggctggagtgtagtggcgcaatcccggtctactgcaacctccgcctcccgggttcaaatgattctcctgcctcagcctcccaagtagctgggattacaggcacctgccaccacagacggcttttttttgtattttagtagagatggcgtttcgccatttggccaggctggtctcgaactcaagtgatccacctgccttggcctcccagtaatttattattttaacttaaaaagagaatgtttattatccattgccacatcatcagatgttgaaggcacaggcatggatttctttcattctaataccatctttttttttttaatgctaccagaagctgtactttagatttgagtattgttgattctaggggatgttttctctttttgcaggcattctttcctttatctgtttttgtcctgtaccacagctaatgaatgaaatatgcattatgaagagaaattaccaaaaaccatgttagtctatctacaacaataactgaaatatctccctaaatgagtttttccagaagataaagctttgataaatatgttggcctagaagtctagatgatataattttaaagcaacaagcaaggcataaatcagtgacaccatctttcacatgttcagtaatgtaaattgaatcaacagataagatagttagggaaaggttcattgcagtttatctgtttggccatagggttttgacagagatgagttagaacatcaggagtcagattttgaatgcaaaaggcccacccctaatccagcaacttggcaaattaaagtgcaacagtgtattacaagagttggggagcaaaaaaagaccagacaccttgaccttttcttcttgaagatttatcatcataatgacagcattaacagcagtggcaaccgccaccaccaccaccaccacaaccacaatacttacaggcgctctcctaagttttatttgtttgatcctgtcaacagtacctatgaggtagatattattatccccgtttcatagatgagaaaagtgatatttagagaaggtctgtttcatttgccccaaatcacatagctagtaagtaagtggcaggactggagcctcgacctggcttctctgactggggacccatggcatcccctgttgtgctctagctactgaacagagagcagagatgatactcaagcccagatggggagcatgtggtatttcttcctatccagagccactgtgaatctgcacagatcacagtatcctgaagatctttcttaattgcctcctgacttaatgcattgctttctttgtaatgcttttttatttttcttttttcactgaaatacttcaatcatacagaaaagcccataaaacaaagaataatacaaccttcaccaatgtatctacctcccagctttgtcttattttcttttaccatatatgcttctgatcttttttaaagagcattttcacttagtataatttaaagaaaaaagctttctgcctatgaaataaaagttctaaactctgactttgctatatgggtataatttgaaatgcattttaaaaggcttcctgagcaaagtcatattctttggaatcagtagagttcaggaccataattaaagaatgttcttctgtttacagctgtttactttcaaggttcatcagagaataataaataactaattttctaaagtgatggcatttcggattttttactaaccttgatttcctatttgtgttctttcccctcttctagcacaaaagctgtgagccgctttcactctccttttattgtagaaaattacagacatctgaatcagctccgggagcagctagtccttgactgcagtgctgaatggcttgattttctagagtgagtttacaatgaaaaaatataatctgactttttgctatcagaaacagactggaaaaatctttccatcaaaaagaaaatagagattacagctcatgacccaccataaaatagttgagtacatgtgttctctgattttatttctttttttttttttttacttttttttttttgatactgagtcttgctttgtcaccgaggctggagtgcagtggcacgatctcggctcactgcatcctccacctctcaggttcaagcaattctttgtgcctcagcctcctgagtagctgggattacaggcacccaccactacacccagctaatttttgtatttttagtagagacgggatttcgccatgttggccaggctgatgttgtactcctgacctcaagtgatccgcctgcctcagcctcccaaagtgctgggattacaggcttgaaccactgcacccagcccgaaagaaattcttaaaatctactgaaagttaagatgaccctctatacacccttcacctaggttcatcacatgttagcatttgccacatttgctttttatctctcatgtattttttttcctgaaacatttggaagtaagttttaggcattgtaacactttacccctaaatacttaagcctacgtctttaaaaataaggacattctactatataatcttaacaccatttattattacatctaaaaaaaattaacattaattttttttttttttttttgaggtggagtctcactctgtcacccaggctggagtgcagtggcgcaatcttggctcactgcaagctctgcctcccgagttctcccacctcagtcattctcccacctcagcctcctgagtagctgggactacaggcgcacaccgccacgccctgctaattttttttttttgtatttttaatagagacggggtttcaccgtgttagccaagattatctcaatctcctgaccttgtgatgcgccctcctcggcctcccaaagtgctgggattacaggcatgagccactgtgccggccaaaaaattaacattaatttatgaatatatttgaatttcttgaattttcccaatgtccccccgccaccggctttagattttaaaatgaaagacctaatcaacttttacatgttgcatttggtaattatgcttctttagtctgtttgaacctagaattatctgccacgttttttgttattttaccatggtattttttgaagagtccttgccattgtctcaaagaatgccttatattctggatttattgatagtcatgtgttcatattggcagttttaagtcatggcatgctggccaatgtttaacagccagctctttggaaggacagtcatgtttgtagagtttgctgatttctgtagtgtaaacactcccaccagggctgatgtcaagctaccactggactggagttgggaagagatgtacacagttgattttcatgagtccataggaaccagctctagaccaccactggtctgagtactttatatataaactcagtatttttcacgtgacccctgtaaggctaagtatcatacccaacttacaaatgaataaagtgagatgcagaaataagaagttaatcttccaagggtaagggttggagcccagattcagccccagccatccggcagccagatgtctggcctttgccagcctgcccatggtgagcctgcaggcatcagtctaaatacatctgttagtctctcactttaaaaccataaacaggccaggcgcagtggctcacacctgtaatcccagcagtttgggaggctgaggtgggcagatcacttgaggccaagaattcaagaccagcctggccaagatggtgaaaccctgtttctactaaaaatacaaaaattagccgggtgtggtggcatgtacctgtaatcccacgtaactcagtaagctaatgcacgagaatcacttgaaccggggaggcggaggttgcagtgagccgagattgcgcctctgcactccagcctgggcaacagagcgtgactgtctcaaataaataaataaaaccttaaacagtaaaaattcagtgacgtccttcagggagctttattgtatttcaagtaatcaacccgacaaatgaaaaaaactaaaaacaaaaaagatatgtgagaatttttacaagctagtaagttggtatcagtcttttgccctgaggagtcttgaattgtaagaccaggaagagattccaatttacttaaatcttttgagactagcttgactcagagtcttgaatggagggatggaaattttgtctattcagtttcttttctatttcacttttaattttctattttaagggttttcagggcctttgagtgtttcagttgtcctggctttttccttagtattaccactgagaatgtgaaaactgaactaaaattacacctttcagtcttcaaggactcacattctagaagggtcctgggatttggtgaggtaatttcatgttcattctattcagaccttacataatttcatagatctggcttctattctcttgtcattattccagactaaagaaagttgaggtctcccaggctaatcatcctggtgttattcttgattctttcttccttttggtccctttatctgttaccaagttcttttttttttttttttcctcgctctgccacccaggctggagtgcagtgatacaatcatgactcattgcaatctctacctccccagctcaagcaatccttccacctcagccccctagtagctgggaccacaggcatgcagtgccacacctggctaatttttaagtgtttttgtagagacagggtttctctatgttccccagcataatcttgaactcctgggctatgtccaacctgttatcaaatttctgattgtctttttccccctttgaggtgtttctttgatttgtcccttcttctgttgtcttctaacagcccattattacctcaaaccattcttactgtattggccttctgactgggccttctactaggttgacccaggagtttttattatattatccctaggctgtaattgagagttgcgaagagtgagctaacagtaaatataacatcatagaagcatatgatactctaattactaagtgaagaaaatcatgtaaagtaaaagtatgatacagttttatatgtgtatatttacataatgcacagcatacagacttttatatttttaaagattatatatgcttattattgtattactaatatgcttattggccatgtgtatatctttggagaaatatctattcctatatacatatgaacatacatacatatatatatgtatatgtagactcaaaatgttaactgattatttctggatggtgaggttactggtgattttaatttctttactttgcaaatgcagttggctcttgatatctgtgggttctgcatccatggatttaaccaactgcagattgaaaatattcaaggaatgaaaaggatggtagcatctatactgaacacatacaggctttttttttccccttgttattatttctgaaacagtacagtataactgctatttatttatagcatttacattgtattatgtgttataagtaatctagagatatttaaagtctatgggaggatgtacataggttatatacaagtactttaccattttatgtaagggatttgagcatgttggattttagcatctgcagggggtcctagaaccaatcccctatggatactgagggatgactgagcatgatttcagaagttcctataatgtacatatattactttcagaataagaaaagtgtattaaagtttttatccagaaaaagaatattggctgaaatttagctagagcattttgcaactagagcccccacttgagagcagcattgattgttatgtacactatttattgaggtaccagatggtgtgactatgatatcattaaaaaaatgattaacctcaatgaacctgacatcagaggattgaataccagcattacaaatgtatttgtcacttactgaggtactaactgttgtgcattagtcacattacttttgatcaaaatgttgtcagaaattaaggctgtagacactgctgtggattaaatcctcccttgaaacatgtctctcttttttttgttctagaagatggactgtgtatattcagtaatcttctcaattgcaaattatttaaaaattgaattatatcataaaaaattatagaaattcatttgcaaatattttcaatttttattaacttcagatatcattgagcaacacttcatggtaaacttctctagtcatcataacactataacagctttagaaccaaagtgtcttcatctgcttcctatggacccagcaatatcttttggccagaggttaaatcatagtgccttgacttcatccttaagttggttggtagcatagtgataaaattgcttgttgttatgctataaacccagtctaccagattgttatctgcattgaccatttttcagcttaccatttttctaagtatggataatctctttgaagtttggcaaagtgtatcaaatggacaaagaccaagatgtcaaacaagccttctttaagagttatgatgttataggtttatgatagtttttcattttattcatgtcttatttataccattgacatcagaaagagcattgttgttcatatcaaaataattacttatcccttcttgcttttttgttgttttaactgaaatgggacccactaagagctgtgttaactcatttccatcttaagaattagatcatcagagatagctaccctcaagtcaagctgctgagtagtagcaaattagagtcttgaggacctgggcaggacctgagaaggaaggaaagagtgagaaaaaaattgaccatttgttactgctaaagctttgatactcatgtccagagaggcaagggcagaaataccaaatatggctgctttctggcaaaagagagggtgcctagataggaggaccggatgggtcagtaattagaacaaagacagcatacgccacagtgcaagagggcaacaagtggtcagatctaaagtcagagccatggctgacgcagtggctcatgcctgtaatcccagcactttcggagactgagacaggtggactgcttgaggccaggaattcgagactagcctggccaacatggggaaaccccgtctctactaaaagtacaaaaatttgctgggtgtggtggtgcatgcctataatcccagctactctggaggctgaggcaggagaatcgctggaatctgggaggcggaggttgcagtgagctgagatcatgccactacactccagcctcggcgaaagagcgagactactacgtcgcaaaaaaaaaaaaaaaaaaaaaaaaaaagggaaataaataaataaataaataaagtcgaagccagagcaggaataacaaggcaaagtcagtgggcacccactcgggtttagggtgactcttaactctaaacacccagggcagttaggtcaatgcaacatgtggcatcttcaaaactagagagcattttattttgttttattttattaaatgtttgtgggtatatagtaggtgtatatatttatggggtacgtgagatattttgatacaggcatgcaatgtgaaataagcatatcacggagaatggggtatccatgccctcaagcagttatccttagagttacaaacaatccaattacactctttaagccactccaaaatacacaattaagctattgactatagtaatcctattgtgctatcaaatagtaggtcttattcattctttctatttttttggacccattagccatccccacttccctccacattttaaagtggtgactgagggctgcctgtctgatgctaggggcctgtccgttttgtgtttgtggttttgcacagattctaacactgttggtgggaatcgtattatttgttttgatgaactttaattcagtgagaaatagataagttatattcattatgttctatctactcagtaaataagtatacagtatactgtgaatatatttttcggttcacaaaaaacagaaataaagctggatagttaaaatgttgtttctagtatctggaaaaagtcatttatgtacaataccttattctaataatactagaaatatcagaagttacagttttaaaaagtcataatgattatataggaatagtccatcattctagtagtgtaatctggatatctttttcaagctaggaagcactgtagaaatctttggatttcagtagtaaacagactgtctcaacatttctgaaacccacactacaatagagaaatgtttttaaagagaggcatttattgtccgtttgttgtctttttcacgtttttggatcatctttaaaaggtcgtacagaatatctgagctacactattttttaaatgtagaaagtaggcaccttctgatccgtggtcagacgcgttacccattgcgctactggccacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaacctagttcaaccattgtggaagtcagtgtggcgattcctcagggatctagaactagaaataccatttgacccagccatcccattactgggtatatacccatgacccagccatcccattactgggtatatacccaaaggactataaatcatgctgctataaagacacatgcacacgtatgtttattgcggcattattcacaatagcaaagacttggaaccaacccaaatgtccaagaatgatagactggattaagaaaatgtggcacatatacaccatggaatactatgcagccataaaaaatgatgagttcatgtcctttgtagggacatggatgaaattggaaatcatccttctcagtaaactatcacaagaacaaaaaaccaaacaccacatgttcttactcacaggtgggaattgaacaatgagaacacatggacacaggaaggggaacatcacactctggggactgttgtggggtggggggaaggggggagggataacattgggagatatacctaacgctagatgacgagttagtgggtgcagcacaccagcatggcacatgtatacatatgtaactaacctgcacattgtgcacatgtaccctaaaacttaaagtataataataattaattaattaattaaaaaataaattaaaaaaaagtaggcaccttatttctattttatttctatgtatgcacaaaaataaggcaagatgctagtaggagtctgtaaaattgcactgtgaagtagggtgataggaagagcacagtttgagtctaggctcaattgctttaggctaactgctttttctctctgaacttcatttgtaaaacttaggtaatgaagacctacctttatggttgttgtaaagaatatgtagtggcttcttcgtagtctttgattagtaaatgtttgttttcctttcagctttccttttggacctatttacagttagtttattacattttctcattttccagtctttgaagaatttgtgacttatcaccacctacttaaacattttttgtgcctcttaatctctcttggaggcagagtagttactataaagatttaagctcagctatatatttcctgttacttaaaaagatactttatacttggccattcttaaaaattaagttttgggtcctttttgtagtttaattatgtacacttcacacatccacaattgatcactacatacagatgtccacaatttatacgacactacacacattgacataaaatactatgatatgagataatgggataatttaagaaaaaagaaaaaagtattcatgtatgttttctgaataagtttttcattaaaagccatttaggcttttagatcaataaatattatagttttaagtagccagagacttgaggcaatgaccattatcttttaaaaaacaaatctgaaatttagtttttatatgcattattaataagataactgaagataagtgaaaaaagtaccttttccccttgtcttcaataaatatttattacagtgtttattttatgccaacattataaactagatgttaggtctacaatggggttaatgagatgagatagacaacctgctttcaagaagcttccagtttagtgtgagagaaaggtgttgaaactgttattccggatttggaggatgctgtgaaggagaagcacaagggaagctgatccacatgaatatttcatgatgttattgaagcaaaatgaaaatgactgctatatttatgttatatcttaagttcaaatgtcagggtcagatgaaatctgtgatatattcttaatggttgatatctttacatagaagttgttttaaatttatatacaaaacagaagcctcaataatttagttattatattaaaaagtaaagctgtttggtgtaatctccatctctcttaactgttaggaatgcctgctgatcatctgtatgcttacactagctgataaagtgattgcttgttgtagagctattataggtttaagatatcagtttgctcacctttttgttgttgctgctgcttccgtaggaaattcagtgaacattatcactccttgtgtaaagcagtgcatcacctagcaactgttgactgcattttctccctggccaaggtcgctaagcaaggagattactgcaggtaagatatttttcattttcctctttatcagtgctttagataagatgacattattcaattaattatagtgtctttattataaaatattacagttactcaaatgtgttagactcttgggaaagctgaatgtcatacatatgtagcttgatttgaaaattaaattcatttcttgcttcctctgtcactgagtacaatgaaagcagatgttaaagtttatgtgggtgacatttttataaagtttcagcactcttttcatttgttagcttttacttgaacacttttataattataaaagtttgattaggcaagaaaagactgagaagatagggactgaggggcattttagtgatctgttccttttgttaagagcccatattcatcccactattctttattgacctctaaacatcccaacatggaatatttattctctttttcataaaggatgttagcacaaacaaatctaactttaaaattcagatggctgggcgcatggctcacgcctctaatcccagcactttgggaggctgaggcaggcagatcacgaggttaaggcatcgagaccatcctggctaacacagtgaaatcccatctctactaaaaatacaaaaaaaattagccgggtgtggtatcacgtgcctgtaatcccagctactcagaaagctgaggtgggagaattgcttgaacccaggaggtggaggttgcagtgagccaagatcgtgccactgcactccatccagcctgggcaagagagtgagactctgtctcaaaaaaaaaaattttttttcagacaaaactttcatacaagttgtatgtcttccaaagcttgattttatatatacttaagaaaaagtaagactaggcttggtggctcatgcctgtaatcccagcattttgggaggctgaggcaggaacatctcttgaaaccaggattttgagaccagcctgggcaacatattgagaccctatctctacaaaaattaaaaaattagctgggcgtggtggtgcacacctgtagttccagctgcttgggacactgaggattgcttgagctcagaagtttgaggctgcagtgagccatgatagtgcccatgcactccagcctgggtgacagagcaagagcctgtctcaaaaaaaaaaaaaaagagagatagaatttaaaaaatacaaaattaaataaagttgttcaagttcaaatgttttattctttccaggaggcatctagattattcccttcactgccataggtgtcatcagtatgctttcttgctatgcgtgttctatcctagtgtatcctcccagctctgtgagttatcctttgcatcctattctgccaggaagcgttttgtcattatataattttgatagcaacagaataagtcgatgtaaattttagtgcagaaaaaatcacttaaaattttgttccaaagtgaaaatcttcctggtaaatcatatcagtgtcatgaatattatataatgatttcacttggcagagcacctaggattttattttaaaattaatgtcacaaatactttcatttttttcttttacaatgaatttgtaacccacctagacaaaaaatcttgtcttcagaattacactctaaaatccaaaaactatccttttttcataattttaagtgtctctctccaacagatgatttcaaagtatttactcagaagacactgtagtcactttttttttttttttttcctgagacagagtctcactctgtggcccaggctggagtgcaatggtgcgatctcggctcactgcaacctctgcctcccaggttcaagggattctcctgcctcagccccctgagtagctgagattacaggcgtgtgccaccacgcctggctaattttcatatttttggtagagatggggttttaccatgttggccaggctggtcttgaactcctggcttcaagcaatccacctgccttggccttccaaagtgctggaattatagacgtgagccatagcgcctgtcctgtagtcactttctttgcaaaatgtgagagcatctgggattttattagccagatatatttaagaagaataatttaggaaagtagtatttattggtgttatgagtaagttcagaaatgtggttacacatgaaagttctgagtcaaagaactataggaggtcattggtaggatattatgcttttgaaaaaagaccaatgaatcaccaagaaactgatgaaaagatgttcaatcttagtaatcagtgagtgcaaattaaaacaatgggataacgctgtttacctgttatgttgacaaacattagaaagtttaataataccaactttaagtgagggtatgagaaaacaagttaactttcatatcctgcttgtaggaaagtagattggtatatctactcttgtctattaaaataaaaaataagcatactctgtgacttaggaatcccactttaaaaatttactctagctttgggaaacacttggacttgtacacgtggagatgtgtataggattgttcattgcatcatcgtttataagtaagaatttggatgcaatctaaatgtttaacagtggaaaatgtgtagcagctttgaaaatctgacaagaagtgatcttcagtatactctactgtaagggcctattgaacctaatttcagtttcttaaaggccatctaaagaacaaagacgaagtttactttttttcctttaaaaaggagagtaaaacttactctgtcttacacttaccatgtgggtttattggattgttttataaatgtaagatgcattttgggatctttagtgatcttattttttctgtatcttggaacattttgttatttcttcatcctgagtattgttttaacattgtttatcatttgtttcaactataatataaaagtctaaaatgaaaagaaaatgagagaatgatgatgcagaagtgaggggagaaatcactatcacgtcatccttctgttttcttcttgtattgcccgcattacatcatcttccaagaaggtataaaagaagagtgcagatgccacagttggagtctgcttctaattttcattgaacacagttgaaaattcagaatttttcgttgttcacccgtaaaggcaaagagaacaaaattgacagaaggcctttcataattattagcttaatcagatgatgaatgtgaagagaaaaaaaccagtgccctgcatattcatggtgatggtgaaatttcatgtatcagcaaaatctgagattctgaatgctcagaaaatatcctaggtgaattttctcaaactcaaaagttggtatgtgaataatatatttgtaagggcaaaatgaactctgttattctcgtccagttagtcattcaataggaaacattcatcatgtaatatttggtgacaagaacctggactgtcctgttttgctgaaagatgtgatagtattcttctatcttttataatatttattcactaaaatttacttgatacaatttataggttacaatttatagacagacaggagattgaaaggatatagatgatgtagaaataaaggtactcatttgattattctaattggtgttgataagtcaaaaaatgaaaatattttgcaattatggagcaaagatgaccatctctttaagaaaattatgagctttaaaagatttcaaaaacttcttcaagtatttgcatttttgttgatacaaatgtgaaaagaatcagaaataatcagctctagaacctattagaaatgtattgaaatttggaatttagtatttatgaatgaatatgttctagatgcatgcttgacggctgatgagcaatgacattcagaatgtcttacccatttcagatatatatgccttgaaaaccaggagaatatggaataaaacttttgagatttgctgtgtttaaattcttattaaaatttgtcatgaggttgattttttttactatccccttattctcatttctgtaaaattatttgtgaaatgactttaaaggaatatattaaatccagatagtaaatggtgaaatctattttttgtgtgtgtactgagagttaaaataaactttgaattttttaagttacagaatgatagattacagtatgacttttccaaagaaatcacaacgagtgtgatgcatacataaacataaatgcacagaagaaggttggaaagggtagacaccaagctggtctcagtagtaacatctgggaaggagagctgagagtagggcagggctcagaggtgcttgaatacacagctaaagctgtagataaaacagatatagaggtctttaaaaagcataaagaacatcaaggtcaaaaaatgattcttgtatcaaagtaaaagatacaaaagaccgtagaaagatgttttaattgaacagcgtatgaaaattttaggtcatttcatttccaagtccaacacatagtttatattaataattacatctagaaataattttatgtgatttactttattgtattcattaatgaaaataagtagcaataatctgaactgttatctttactaatgaaaatattggtttgatctcagacaacaatagaaaaatgaagaataaagcccagcatggtgacatgcacctatagtcccagcctcctcaagaagctgaggcaagaggatcacttgagcctaggagcttgaggctgtagtgtgctatgattgtgtctgtgaatagtcactgcactgcagcctgggcagcacactgagaccctatctcttaaaaaaaaaaaaagaaagaaaagaaaaaaaagatcttgtaaaggtaaactacaagggtgaagccatttataagactcttctaaagtatgtgcttcagtgcactattataataataaatgttttcccaattttgatcttatagttcaaatttaacttttatactcaaggttttattctggacatatgttcttaaaatctatgtttaaagttttgttttctgtcgtacaaacagagtactgaaatttttcatgctatcttagagttttttttttaaggctatttccatgcctagtaaattgaaacatatttcttttttgcagaccaactgtacaagaagaaagaaaaattgtaataaaaaatggaaggcaccctgtgattgatgtgttgctgggagaacaggatcaatatgtcccaaataatacagatttatcagtaagtaccttatgccaaaaaataagtcgatgataacatcccaaacttttacataccaaagaaacatttttataattaaaagttacccaaatttcaactttggctttaaatgggctaagcctggacatagttttatatttaccacgaaatgtggaattggtgctatttccaatgcaagattatcaataggtttagtaactaaaagtttagttctaattagttatcctaggtaacccaataaaaatattttacatttgtaaatacccaatatgcaaatagagttggaattataccatagttttgcaaattcatgttagcatgtagtgttccatcctttgtactgtgactattttcagatattctatgcaagaatcagagatgcctttgcagattccagtgatgagaattttcattataggggctggatttctcttacataacacaaatgatcctgaatacttaatttacttaacacatacttactgagtgcctgtgtctcaggtaatgaagtattaggaacagagactagtaagcaagacagaactcttccctgccctcacagagcttgttgtatagcagagaagataggctagtgcaatacagcttagtgcatggcatgatagaggagaccaggatggcctggggataggtagcaggttggcctaacccaagggcagggaagcattgaggaatgttccccagggaggagataccaactgaagaatgagtcagtgcaggccaaggtattgaaggggagtattccaggtagaagaaccagcatggcagatattggaagtgaagcatagcaggaggaattcgaggaactgaaagatgatgagtaaggttggagtgcagagtgtgaacaaagaagtgttcagagataaggaagaggccagttcactcatatcaagaaatttgcatttttacccctaaaagattaagaatactagcaagagagtgatagaagctgggtaaaaatagtgaagttatggcagggtgtttgagttccattgtcaaagctaaatggagctgggcactgaagtggtaaggattgatcttattcagtaatactcctgcatagggaagagtccagtgtgaactgaacttgacttcattttggcatagatgactgggtgttttaaagggaatacgagggaacagggaaagggaatgagctgggggaggagagagagtgaggtgtggttatttgaaacctatctgggtttactaattgtttgcttataccacatttcaaagagtcagctctctggtccttaagaagacaattctgggtgatagatttacatcacaaaggggcagaaaaagtatttataattgcaagctttctaaggtaactgttctaagaagggcttcagcatctggctgcctgtcaccaaattttggctggaatggcgaatcctggcagcactgagttttctcaggcagatacttttagtggggctggggtcatcctaaggatgcagccttgagctgttagaaactatgctagtggggtaacttctaagtagggagggtggacaaaatcatttttactcaaagtctctaggtttttataggtcaaagttgagaactagtccagaagagggctcagagaaaaaacctgatgagaatttggtcaaggacatggggtaaaacggtatggtgatgggtcaaaaaatgaatatgtagggagtagttatgtgagagagaaggtatcagagaataaaatgcctgactttcagatatcaaatgtgctgtttttctggttgatggcaagatcttatgtatggctatggaaggtgggtagcagaagggagaaggtctttggagatgaagagatcaaggaacagagtttgggaaaaagttgtccatgtgaatgttgaaatctaagataacagcaagatatgccatagaggaaaacagggatccaggtgtctgagattgcgagaaatggcgattgggaatcctgaagtttatagatagcttagattgaggacagacagtggtaaagccctaaagaagagcttctgaaccctgaaccctgaggtacatggtccatggttggatgtggcagaaaggtcagcgcccaaatgagagagctgcaggggaataacaaacagccagccagttttcattttagtgtatgaaggaaatgttaagcaaggtggttagaaacagaagtactaaggaactcttctgaggacagtgaaagaattgagatgtaggggagcatttggaatgtagatcagagaaagctcagagtagtagcgagctgggactgtaacagagtattctacctcgggctgtgagcagaggtggcagagatgtgtggcatggtgcatttggctggccatgagagggggatgtgaagggaaatactttgaatgacatctagtttaatttataatatggattttcatatcataacaagacttgttggtagtatataatgcatgtcttagtctgttcaggctgctgtaacaaaatatcatagactgagtagctcataaacaacagaaatttattcctcagagttctagaggctggaaagtccaagatcaaggtaccagcagattcagtttctggtgagggcctgtttcctggttcctagatgacacctcacatggtggaatgggtaaagggtctcttactcatgtattcacacagtggaagggataaggggtctctctcaggccctcatgaacttgtcatctcctgaaggccccatcttctaataccattgccttgagggttaggatttcaacatacaaatttgggagagagacaaatattcataccatagcaacctaagacccaatgtctataaacttgttcattcttttttaggaaatttttatatgtggtagtcaaacaagttaataagtaccaatctttttattgtctttaaaaagaagactatgtctttgagaggccgaggcaggaggattagttgaagtcaggaggtcgagaccaacctggccaacatggcaaaaccctgtctctactaaacataaaaattagctgggcatggtggcgcctccctatgattccagctactcaggaggctgaggcaggagaattgcttgaacccaggaggccgctgcactccagcctgagcaacagagtgagactgtctcaaaaaaaaaaaaaagaagactatgtcaacataagaattttttttttcagttctcataataccagtaggatatagcttttcttgagaaagtaatataagttaaatataaactaagcaactaaatattagaactataagtttcttaaaataatttcctgttactgtttccctgcccatctacttgacctcaagaatattacccttgggattgacttatttctttttttctttcctttttcattctttttctttcaaaacgtatgttacactttaataaagcaagatttgaagaactaaaatagccttctgtctaattacaataatgttttaaagaaacattgaactcttacatttaaatctttacaaagtaaatggagtaatttttttttcaagcaggcacctcagaatattccagaatattcgtttctattacatatgctttttctaacttgagtaggagttgatatagaactgttgctatggtgaagtgcattctatttttcagggtaaaaatttatatatagggatagtgttgagaaagaacttacgtaaaattcaatttaaaatattttatggatgttaattataaaatataccctgaaaataatttcaaagttaaatgacattgttgtttttgataatcatgtggttttaagaactggtgctttgtacatgtaactataagtatacttttctgtattctgtattacatgaacttattatagtgcttctgaataagccaactttctgcccgcttttcctctcccagttttaagaatactttttaaaatactctttctttttgtccccttccttgattcactatataatccaagcatttatacatgtggtcaccgctggagctccctcctccaccctgcccacctccatggattctctactctgcagccacagggcttctggaacgtgccatgccactctcccttttgaattcatacttcacactccagccagattggacttcatgccgttcccaagtcactgtgcctctgggacttggcagatggttttccctctgcttagaatgtcatctttccccaccccacccactcccgcctcacacactccaacatccacccacccaacacccacccgactccccagctctggcttgttcaagtcttgccttggatgtcagctcttgcactcagccttcctttgcccagctgggatgggtaaccctctcacataccctcgccactctatttctccacatctcagtacttattccaccaaattataatcattctttttttatctgcctttcccagtggactgtaagcatgaagagaacagggactacatctctgtcacctatgtgtaatcccaggatcagtcacagttctctggcacatagctggcacctaatcagatttaataaatcagtaaggattagctagaagccttcagcagtctccaagtctcacttgaaatttttgccttttattttctacacaaaatgttttttttcaggatattatatggggattgccccaatttacagaataattttactgtcaaactaaaagggaaatttgggatcttttagtgtaaccacgtcttcatacttctgagtaaactatggttcagaaaggggaaatgatctgccagaggttgctcaggttgggtcgtcttgaactgtttcccaaaacataaacatattttaaggcaagccagtgctttccaacctttttcactttgcatcacacagaaaatgatagtattttaatggaacactggattaaaaggagaaggaagaggttgctcagaggccaaggaggctggcccagggactgtggccgccccagccccacccaccacctgtgggttaaggggtcagtatcttggcacccctgtcaccttgtgaggcagcccaggactgctgcttagggaaaccccagcgaacccactgcaatctcaactctcccaggattgtttgttaaaccaaatgactcttttttttttagtggatggattttcaacagcagttaaagtcggggttttcagttcatttgtagggtttttgtttttagtataaaaaatataaatttcaactaatggaggggaggggaaagagtggttgacagcttctcagtttgttgggtgggaagaaaatgagtcaaacgtgcacaacaggaagattcccaggaagcactcgaaccctgtagctctctagcccaagcagaattcacagcccaggtgttttattgctggggcagggtagacattgagatgctagtcacagtcccttcttgtgagatcaagatgggcctagggtgcttcagtcattagctccgcatgtggtatggaatgggtgctcacacatttgttacatgaacaagtgcttgaagctggtaaagatgaacagatttcccaattccttcccttatctcagtacaaataatgtctagctggcccagaaatacttgctttggctgtataaaagtttaaaagactagttacagtaatattcataagctgttgacaatttgtgcctaattaccaagtggaacagtaataatacataccataaaatatgtctgagctttaagcttaatttaattccatggctaaattatattctcacagattctgctgtaaaggtgtttttcacatagcatgatctttgaatcatgagcccatggattaaaattctaggaaacattaatggcaattgaatattgttttcttgtcagtcctttcctctggttctcctctctcctgcttctgaaacaatggatagagaaggacatttgtctgataaagtgttctgacctgcactgctgtctctgcccagaatggccctcccctctcttcttatctcttacctgtctgcattgattggactcacactgttcctgcaggacccaacaaaacactgcctcttcctgagagccttcaccatcctctggccagaaaaaatccctttctattcaagcactttctttgctctgtttttaaagctctcacatactacttttgttacacaagtgtagtgggaaagtggctcacaatggtaggagatttaaattaaaatcctgctctgctgtcatttcactctcattttggatagaccacgattacttgctgggccttagtttcctcatctgtaaaaggaggtggttaagctgggtcacagccagccctcacacccaggggaatgtaaattgggcaggatccaggtgttggagggatttaagtcctgactttggcatctcaacatgcagctggtgccgctctccagcttcattttccctctttctgtttctagttcaccttgggttaaaagtgcaaagatttggctgagagctcgtctggaggaggctttgactcaagagtctcttaccataacctgctgttgattgacattttcgaggaataaaacactttgaaactaccaaactttttcagcagtctgcagctgttataaaaatagttctcccataattcttctttaaagacagttgtcaatatttatacctgtcaaggaagatagcacttttttttttttttttttttttttttttttttacagaaaattagcttttcaggtcttagaaattaacatgtgacagttttattttattttttttctgctgtacatctgctgacttcagggatattatgactgtccattattctagtgtactcaatgatgaacacatggagtgaaagcatgtcttctcctatttagtagtgactatgattccctgtcattgagcaagcgtccccattgagacatgtcagaggatgaacttcacttaacattccagttctgcgacttagttgctgggaaagatatttagctttaggcctctgtttcctcacctgtataatgggaatccagtaatattagtattaccctgtgacattgttgtaagaactaaatgaagtgatacatagaaaatcattagcacagtgcctggcacttgttatctgtgattttcttaagatatcttgaagtttgtcttttatttttagatcttctcttcccccacagaagttgacattctatgtggaagttgcttagttatcacaagttttgactcactgtttagatactggataaacaatactaagatcttattgattgatgctattcagacagatattgccaatactaaagggaacacttaatagaatgtacttctagtctcttcataggtttgccaaggcagtcctctctagttgttatccagcaacatagtcccttcagcgcaatacttccagcttttgtttgctatcattaattaattcattcatccccctttagtttcttgagaacttgctctgtgtgtggcctccttaggcttggtgctagcccagctttgggcactgtctaggccagtctggtattcccagtaggctccagagtgtgtggagaggtggttattgccaactttcagattctggctatttggttagaacattcactcatgctaactggtcctgccgatagattttatgtgtcttttatatctgggaacccttgatgtgtgctgcctcaaatacgcacgatctttctaaaagagattagcacattagatgagtgaaatttcttgaccatttccttacttattgtgtcatcttgggaaccgtggaaacaagggggtcatatattcttgacagatttttatagagaaagcaaatgattgtttttgaaatgtaaacatggtggaaatctctgctgtaatgccttttgtgtattacattcatctctttgatctatttattgggtgccttctttgtgccaagccttgttctaggcaacggggatgaactagaagacacaattcctgctctcatgagaacttactttctagaagtgagattggtaataaataagcaagaaaattcaggtaatttcagagaaggttgaaaacaaaataaaatgggctgatgtgatagagaatcacagagcagaggggcttctgtagattgggtggtcaaggaaggtgtgtcctgggagttgatgtttgagtgtagacctgtagaaaggccttaaggcaggaatgagcatgttgtattctggcaggtggaaggagagcagaaatcaagtctggctagcaccaagtgaacatggtggagggtggtagaagaatggatcggaggcagacatggcctttagactgtgacctttagacacttagaagtgctctgaggatctggatgagggcttttagcaaaaaacaagttctgttttactttttatgacagtcactctggctgccctatggagagtggattgtgggcagaggagaagcaggaagacccagcaggagccactgcagtcacctgcctgggcagtggcactgggcatggagacaggaggttttatttacctagaggacctcctgattcttcagtcttgtgtcttttttcctgctggtgtttactagagtgcctgatgtacaacttatctcgtgctggcagtctcttagggcttactaagaaagccaccatgttgtcacctacaaatatttgagtttagtgggttgaacacatttaacttctaaagccttgaagttagttcttctttgacatcctcaaatcctggggcaggggtggtgggggctggaaaaaatctgtctctacaacagtatccccaagtctgcccaggttcaccatgcaccacttttcccaggtacttcatgcaaacgaattccacaacttctcatcttccaagcaaatctggcacagagctctggtgccaatttaattcctgctctttcattccacccagggccacatattcaagcaatgtacctgaatttaggatgagagatcttatttaattcaactccctgattttagaggggaggaaactgaagcctagagaggtgtattggcttgtccagagtccacactagaaaccacctttcttttgtgggccaattctttattcatgtttatacttttattttcacactctgttattttcttgcttatcaaggctctcatagaaattgacgccacagtgaaaatttttgtataatacttgacatagtatgcattcaatgaacaaatggttgttagtactctcattgctgtagaatccatttacaaataagtgttagattaagatttgaaatataaagaaagggaggaaattgctccttaattccaaagatagccactgttaacattttggaatgtttcctttgtctttctttgtaattttttttaagaaatagccattttttatataaaaatttttatatcctgctcttttagttaatattataacatgaatattttcctatattcttaaaaagtcttaagataacttttaatggcttcatggttttcaacaatatggatataccataattgccttaatattttctctgttgtatctactctttgctgtcatgaataatcctgccatggtacctcacagaattgattctttaaaaaaacaaaacaaaaattgggggcacatagtaggtgtgtatatttatggattacatgagatattttgatacagacaccgaatgtgtaataatgttaccctcacatgagggtaactggggtatccatcacctcaggcatttatcctttctttatgttacaaacaatccagttatactcttagttatttttaaatgtacaataaattttgttgactatagtgaccatgttgtcctatcaaatactagatcttattcattgtatgtaactatatgtttgtacccaaggaccattcaccttcttcacccctactacccttcccagcctctggtaaccatccttctgctctttatctccatgagtttaattgttttaattttcagttcccacaaagaagtgagaacatgcaaagtttatcactttgtggctggcttatttcacttaacataatatcctccagttccatccatgttgttgcaaatgacaggatcttattctttttttatggctgaatagtactccattgtgtagtgtaccacattttctttgtccattcatctgttgatggacacttagtttgcttccagatcttggctattgtgaatagtgctgcaataaacatgggagtgcagctgtctcttcaatatactgatttcctttcttttgggcatatatatatatacctagcagtgggattgctagatcatgtgttagttctatttttacttttctgaggacctttaactcttatccataacagttgtactaacttacgttcctaccagtagtgtacaagagttaccttttctccacatcctcaccaacatttgttattgcatgtcttttgaatatgtcattttgactggggtgagatgatatctcattgtaatttcgatttgcatttctctgatgatcaatcatgttgcacctgttcatatgcctgttgtttgtatgccttcgtttgagaaatgtctattaagatcttttgcccatttttaaattttttttcagtttttttcctgttgagttctttgagctccttgtatagtctggttagcgttcctttatcagatggatggtttgcaaatattttctcccattctgtgggttgtctcttcactttgttgattgtttcttttgctgtgcagatttttatttaataacttgatgtgatcccatttgtccatttttgctttcgttgcctgtgtttgtggggtatttctcaagaagttattgcccagaccagtgttctgaagattttccccaatgttttcttctagtagtttcatagtttgaggttttagatttaagtctctaatccattttgatttgatttttttacaaggtgagaggtaggagtccagtttcattcttctgcatatgggggtattgaagagactgtcttttccccagcatatgttcttggcacctttgtcaaaaatgagtgcactgtaggtgtgtgaatttgtttctgggttctctattctgtttcattggtctctgtgtctgtttttatgccagtaccatgctgttttggttatatagctctgtagtataacttgaagtcagataatgtgattccaccagttttgttctttttgcttaagatggctttggctattcagatccttttgtgtttccatataaattttaggattattttttctatttctgtgaagaacgtcattggtcttttaatagggattgcattgaatctacagattgctttagttactatggacacttaaacaatatttattcttccagtccatgcatgtggaatatctttccctttttgtgtgtcctctttaattttttgcattagtttatgtagagccctgggaccttgaatgaacataggttgtagtcagacagtggtcaccatgggccttgggtgagacccagtgttgtgatggcttcaggtctgacccagtgagcattgaagaattaggtatttattgtagccttcacagtctagcttgtttgtacttgttcttgggaaggctttccaagtattcaaagggacttgagtgttctgatctaaatctgtggtcactgcagctatgtctgcattagggggcaccccaagtccagtaatactgtagctcttgtagactctttgagttaccaccttggtggtcttgcataatattctggaaaattccctggatttctaggcagagactcttgttgtcctcctttactttcccccaaacaaacggagcctgtctctgctgagccacctagagctgagggaggggtgactcaagcacctctgtgaccaccaccactgggactgcactgggtctgacctgaagccagcagaatactgggtcttacccaaggcccgtggtaaccactgtctgactaccatctatgttcactcaaggtcctagggtctacagtcagcaggtggcaaatccagcctgaagggctatcattgtttataccaccatgcctggcaatagtgaatgatactctgggagggaagtaattaatttgaccttaatgatatgtatatgattaggcagccttgttctttgttagccttcaacaatagggatctttttggtcactgtcacaggagtgaagacagaatgacttaccttgtaatgtttgttttctgatacattgggccaaaagacccacaggaatccacccgtcatctccagaaagtgaagtttttatttgaagtttgttctagtgtaacaactttcatcacatttcatgtttcaatagatgccaaagcaaagcactgagtgtgttggtatttctgttgcctgcttcagcagtgtctggctctcaaagttgtagccttgctacctaacctgagaccaaaatagccaagagcgttaaaactggtatgtgggttgggaaacaaacatagtgatcaggcaagccattttagaaggggtggtggaaaaaacttctccatacacttaagtcttcttaatattattttttacttttcaagcatctaaatttcccctaatgcacacaattaaatactgaaatatacattagaatttattcattagaaaatttgagatactctacactttaaattgaacttgtaccgtagaacttttaaatgattaggaatgtatgttttatagttaaaagagattacttagagtaattttttgtcttcactttcaatatgatgccccccccccctacctttttttttttttttttttgagatggagtcttactctattgcccaggctggagtacagtgtctcaatcttggctcaatgcaacctctgcctccagggttcaggcgattctcctgcctcagcctcctgagtagctggaactacaggcatgcgccaccacgagctcattattgtatttttaatagagatggggtttcaccatgttgccctggctggtctcaaactcctcaagtaatctgcccaccttggcctcccaaactgctgggattacaggcgtgggacaccgcacccggccccaatatgatgccttttgatgacaaaaaaagccttaactttaatgaagttgaaggtatcagtccttctttttatgggtgaatgcttttgtgccttaaataggaaattatttcaatccctgaggtcttaaacatattctcctataattttttataaacattttaaagtttaattttcaaatttcagtcattaatcaatctactcagaatttatttatttacttatcttttgagacggagtttcactcttgttgcccaggctggagtgcaatggcgcgatctcggctcacagcaacctccgcctcccaggttcaagtgattctcctgcctcagcctcccaagtagctgggattactggcatgtgccaccacacctggctaattttgtatttttggtagagacggggtttctccatgttgataggctgctctcgaactcctgacctcagatgatctgcccgcctcggcctcccaaagtgctgggattacatgcgtgagccactgtgcctggcccagaatttatttttatacatgatatgagttaggaatctaatttcatatctttctatatggataatcaattgttttgtaccagttttcaaatcatccttttcccatcagtttatggaattatttatcatatattaagtttccacatttttatggggctgttctgaactcttatttttcactggtcagtgtttgtgtgcaagccagaatcacacaagcttatttgctatagcattataataactttttacatctgtagggaaagttctcccctcctattctcctaatagaattcctaatttctatttagcttttgctcctctctctattttagagtcaacttactcagttaattgggggaaaaaaattgagatttgtattggaattgcattgaccctatagatcaatttggggaggagttgacatctttatgatacatatgtgaacatatgaatatgtccctccatgaaaccagtagatacagtcagtcctcacttgacattatcaatacgttcttggaaactgctggctgggtatggaggcttacatctgtaatcccaggacattgggaggctgaagtgagaggatcacttgagcccaggagttcaagaccagcctgggatggggagacctcatctctacaaaaaaattacctggatgtgatggcacccacccatggtcccaactactctggagactgtggcaggaagatctcttgagcccagaaggttgaggcacagtgagtcatgtttgcaccactgcactctagcccaggtgacagagcaataccctgtctcaaaaaaaaaaaaaaaaaaaaaggaaaaggaaataactgcaactttaagtgaaatgacatataatgaaaccaattttaccataggctaatggatataaacaaagttaaattcctatgtcatatttctggccacagaaaacatcatcaaacttctaaataaagacccaacacacttctaatattaaacattgaaaaaagtatgaactatgtgtttaagaaagattaataaaaacaaataagattattggatacacaatttttggtaaatcagggagtgacagaggtcatagtgatggtgggttaaatcaaggaataaatgtttccatagtgaaaattgtgagaagtacctcctactaccatgcagctcaaaaacgagtaatacgtgcggcagatttgtttatcacttttgtgttacatcagtttattgtcatgcatttgtatgattatcacctgccttatgaatttttacttgacaatcatttgtattcactcattttccaacccacttattccattttggagtcatgggtagccagagcctatcctggcagtgcagggcaccaggcaggaaccagccctggacaggatgccatcccatcacagggcacactaacagatacccacctcagaccggggctattacaccaatgaacctaacttgtacatctttggcatgtgggaggaaactggaatacccagagaaaatccacacaggcatagggagaatgtgcaaacacagtggccaggctgggaattttttttcccttatcaattttgtaatgaaatgacattatttgaggacctgctgtatttttattttggttttaagtcctttcaataaattttaaaagtgttctctataaagggtttttacatcttttattagattaattactaagtactttttgttagtatataggtcatatcttttttacaatagtcttctaattatttgttgctcttacagaaaaatgcaactgagtttgcatcttgatcttaaatctagccattttgctagagatcctctcattaattataatactttgtatagagattccttttggttttccttgtggacagctatgtgatctgccaatgacagttttgttttgtcctttctcatcctaatgcctttttattgttatgtttttctatctgggacctccaggaaaatgtggatatcgtgtcttgattgacctaaggaaaggcttctaccatttcaccattaagcctgtgtttgctgcaggattttggtagctagccttgacctggttgaagaagttgtctaagggtcattttgttctctcactcactcaccacttagtggtggatggtgtcgggaagaaacctgtttcccagctaaataaacatggtttaaatattagagctgtgaagtctaaatttttatatgatattttttctatatatacaaagaattgatttttgtatatcaattacctctgaaatcctgaagttcaaataaactaaaaacttcatcattccctattaaattcaggagaaatgaaatgctcaaagaacatatacatgattgtatagttttaaaagccagcagtttctgtgtagttcaatataaaaaatgttattccttttgaaaatattggaaagggaaagtgtcagacttacttactttgggtaatatatcttcttcatatatatatatatatatatatatacacaatctaaattcgaagagagcaatatttctattcatgtaaatgccatacacattttactcatcaaggccttcaaataagtttcacatctgacttttacattaggcctaagccaaatgtattttcatttgttttagttcatttcttctgtttcagttaattagtttatagggcattgggacttcatgtggctgctttgggcatcttttatttttaagaatttatgatttataaaaattatagcatttatagtttcaaaggaatttcatatatattttcttaattgttttaaactttacaaaatgcacgtaaggctaggatttctgttatttttaaattttacagatgagaaaatgaaatgtatttagccaatggctaagccagaaatggaacctcagtcttctaactctaaatggtattataatatgctttaccactacaaatcttattaaattattttagtttaccaagttaatacttttaaagaatacactgtcaaattattgattcttattgtgtgaaaaagccaaattgaacaataagtataaatactcttatctttcaaggtattggaaggcataggtttctacaaaataaaaagtgtatattttttctttttttctcatatctttctaaactaccgatttaaaaacatttctatttctgcatttccattggtccctctcatgtgcttgttgaatttggtaatcccatttgagacagctcctttaacaatgctgtcacagttcagggagccttggcatgacacacgtaacccttctgtgcggtattctctctggcattgcattcttacattacattctctctggcattacattctttcactttccattttgtacttttctctattgctttatttgtatgtaatgttctgaagtccaaataacaaaatgtcatttggaagttatgtgaattattcctaaattacataaatgtgtttgtaaggagttattgaattgtttgtgatggtgatccatgaaataactaagaaaatttatttgattttttatgatttcagccaatgaaaaagtatataaaacagtataacagacacctatttacccatcacacaaatgtcgtagagattgacgttttgtaatatttaggagttttttaagtaaataaaaaattgcagatacagctaaggtcatacgtaattaactgctattcctttttctccatcttcatctcctaacctacatggtaaccattatcctgatgttatttattatccttatgcatggtttttattcttttgtttgacatacatatatatatatatatatatataaactagtagcatataatcatgttttgtgtattttaaaaaaggtacattaatgtctcactgagcttatcttagtattctgcattgtaaataattgttttaacaattgtacaagtagatctatttattttcctcacattagacaattagattatctctatttttgtcagttatgaatacatacaaacaatattacagtgaacagttttatacatgcctttttgagcacttgtatgtttcttgggtagatgcttaaaagaggaattgctgggtcatctagaccaatatacacaatctttaactttgctaggcgtttccatattgctctccatatcttgacagcatactgtgttgaaaagactgtcctttgtctactgtgctgcagtgtcacctttgtcataaatcaaggaactgtatacatgtcaatctgtttctgtgctttccattccactggttagatatgtatgtcattgtgccaaatcacactactgtaattactgtagcattataatactgagtcatccagttcatgaacatggtatattccttcatttaattaggtcttctttaatttctttcaataatgttgtgtagttttctgtgtagagacttgctcattttgttagatttattcctaggtatttgatttcttttgatactatggtaaattgtatcattaacaatgttttattttgaattacaggttgggcattcctaatctgaaaatctaaaatctgaaatgctccaatgagcatttcttttgagcatcatattgttgctcaaaaagctttggatttcagagcattttagattttatttgtaatgcaaatatttcaagataaaaaaaaaattgaaattggaaacacttctgtccccaagcgttttggataagtgatactcaacctgtatttgttgctaaaatataggggaaaagttgatttttgaatactgaagttgtatccaaaattcaatttttatagatttccttggattttctgggagcacaatcatgacatataggaataatgagttttattatttactttctagcccttataccttttatttttatttccctctcctgcccatttgtttcacaagtgaatgttgaattttatcaaatactttctctgtgttattggagataattgtatggtttctttattctgttaatgtggtgaattacattgattggcttttgattattaaaccaactttgtattcctcaaaagctctaaatggtttgtataaccttggattgacttattaatagtttattaagaagttttgcatgtatatttatgggtgaaattggtctgtaatttttcttgtaatgttcttttcaggtttgataagatatccaaatctgaaattatttgggaaaaattcttgttttgttctctggaagaatttttgtaatattcgtgctatttctttcttaaatgtttgcaagaattcagtagggatgttctctgcatttagagtttttcttgtggaagggcttttacaaatgtaataaatataggattgttagattttctatttcttgtgtcgttttgtgatttttaaaaaaggagatagacatattaaaaaagagattaaaaagagattaaagagattaaaaagagatataaaatatttgatcatgccaatatttgattgttttatgacaggcttattttttaatctctgtagaattcattttatttttatcattatttttatcattgttttatgacacgcttattttttactctctgtaaaattcattttatttttatcattagttttatcattctgcttataccaaactactttccaggttcttattgtgttaagctctttctgtcacaagaaacacaggtatactcaagttccttcaagtaatggagatatattaggtgcaatataaagccatatggagccttaagagaaaggaattacacaggaagagcaggatctctagcacagtttggcattagggagactggaaatgtgtggctaattagaatatgatacagctttagggatggaacaggttttctttttatcccccattagtaacatgttataaggctttactttgatacccagttgtttgtgtgaagtttctcacttccttttggcttttgtctatcttttcttcctttcattactaattaccctctttacccctggtctaaataatttttcatcataccttttattttctcataactacttacttatgatccccagtgccttgtggcctggttctgtgattctttttagcctctcttcaagttaccaagtaattgaacctcactggttctcagttaactcccaaaagattatttgattggcctagtttgagaagcttttatgctagctaggcccattggctggttctggctttttttttttttttttgagatggagtctcactctcacccatgctggaatgcagtggtgctgtcttggctcactgcaacctccacctgctggattcaagtgattctcatgtctcagcctcccgagaactggcatcatcacacccagctaatttttgtatagttggggttttgccatgttggccagcctggtcttgaactcctggcctcaagcgatccacctccttggcctcccaaagtgctgagattacaggtgtgagccaccgcgcctggccagcttggctactcttgaccagggagctattgccaaaatgtgggattcacatagcccagagcatggatgccctgggctaactcctctgccaagggctgtagttggacagtttcccttagcaggggtgtgtacctggaaaatactataattgatcagtacagataagtcctagaaaattaagttgttgcaagagttacaattctgcctcgttcacatgctgtggtgaatgctagtaaataattaaatgctggtaaaccaatgtctagaatttgatgttatatcttttagtagtcatctacctataactgaaaaattgctgccaaaaattacatgtgctgccaaccccaaatagggccatgggcaaatagatatgtaatacctgttgttttaagatggacaaatggaaattgatagtctttaaacataagcaatagggagaatatgcacataggcagattaaaaaatgcttaatgagaaagccatagcagttatccacttctggtcttatttcctttttaatacccaggaatagctgtgtgtactgctaagaattcacttttctgcagtatcacacagttcaggttgaagacagaggaccgctttccttttgtgatatttatgctacaaagtaatgttttgcctaatgcatttccacttatgagataaattgtggatattatcaaaaacttttctggtacaataagtgaaattcctttctaattttcaggaggactcagagagagtaatgataattaccggaccaaacatgggtggaaagagctcctacataaaacaagttgcattgattaccatcatggctcagattggctcctatgttcctgcagaagaagcgacaattgggattgtggatggcattttcacaaggtaagtacgttaattcagcttgcatatattcttgaaaataagtcaagcccacattatcgcatgaattttccttttgtgtacatatttagatgctcttaaagcactcaacatttaggagcttaaataaattatttcaaggccgggcacggtggctcacacctgtgatcccagcactttgggagaccaaggcaggaggatcacttgagtctaggagtttgagagcagcctgggcaacatggcaaaaccccatcttgacaaaaaatgaaaaaattagccaggaacctgaggtgggaggatcacctgagcctggggaggttaaggcaacagtgagccgaggtcacaccattgcactccagcctgggcaacaaagtgagaccctgtctcaaagaaaaaaaaaaaaacaaaaacaaaaacagaaaaaaaacccacgttatttttattatgactgttaatactagaaaagacttaagagttaattttgtccaatagcttccaaattatttttaattattgagttattttattttatttattattattattatttgagatggagttttgctctcgtttcctaggccagagtgcaatggcactatctcagctcactgcaacctttgcctccccagttcaagctattctcctgcctcagcctcctgaatagctgggattacaggtgcctgccaccacgcccagctgatttttgtatttttagtagagacagggttttgccatgttggccaggctagtcttgactcctgaccccaagtgagccgcccgccttggcctctccaagtgctgggattataggcgtgagccaccacacccagctgagttcttattttgaagaaaatcttttgtagaaaatcaatatttaagcagataaaaacagatctgctctgtcttctggggtagaaggcttggagacttggctgttaggctctgtagagcacagtctgaaaacttgtccatcctccccattttaggtgcagacctgaaacaaactgcaaaaggcattggaccaagatcattttgttgatatccctttttactctatgaacattacatgcaactgactaagtcttaccctcaatgtgtaaacctaaattttatgccgtgttaggaatatgagtgaaatatcctggcttcactaaggagaattcgtagtttaatctgtttaacaccttctgatttatcagttcttaaagcatcgtgtatatttcttacatgtacatttctaaaaagtaaatacagtctctgtgcatagtcaagctttgtgtatagagtgtcttgagttgttgtccagctacgtatttatataatatttgactgtggaatcacatcagaatatatcacatgctaatattgatattcttgagtagacactaaaatgctttaaagcttcatttttcatctgagaatgaacaaagtaccctgaattctgtttgatgccatgtcaccaaataggtgttattctgatccccatatatgtttaaattaactcaaaataagaaatttaaagagtctttctttagttcttaagacttaattgattttctattttataagaaaaacaaaccaggtattttattttggttacagtattaaggaaagtagcagagatatttagtaaagaaaaaaaaaagagaaaaaagaaaaaaattattggtcaatataaggggatttgcctggaaggaaatcttgttactgagccgaatagcaagaatgtttgtagatacaagtaaaataaaagaagggtttatttttgtcatataaggagaaggctggaggtgggtagctacttctggtgtttcagtggctctgccatttcactggcctttccctcagagttgtaagattgctgctgcagctccaggcatcacattcctattcacatgaggtaaaaaggagaagggactgccatagctcccccacaccctttttttaaaaaatttttttaggacatagtaggtttttaggatcctcccagaaaacttacctttcactgaccagaactgtgtctcatggccatagttgcaaggaaaacagaaaataagaaggtagtttttgtccagcttttaaatagagttaagcacagtaattgggaatacaatcagtggtaatcagaaaatagtttctgtcacagggtgtggaatcagtaataatagtaacagccaacctttatgatatatttacaatattagtgtaatattcttatcaaggtacaggcactgttatgtgcaccttatatagagtactttatgtaagtacattcaatgagtacatgtctaagccttctaaaccatgctgatttcaagaaattggagtatttatccattcattttcatttattcattcatccaacatgtactaagtgaatacctaacatatggcaggcactgagaatacaaaggaaccacagtttttgatttcatgaaagctatgtagtggagaaaatcagcattaaccaaataatcacatacagaaatgtgaaactgcagctatgacaagtcaatgaaggctatatgcaagatgttaggacaggctgtgatcctgatatgatctggtcaggaaggtcaggggaaggcttcccttagcaagtaacttttgagtgcctatctgaaggatgagtgtaagaaggaaggaagtatatttcagagagagcatgtgcaaaagtcctttagcataaaaaacatagacaatgagtgaagggtggtcctccaggagagcaagattctaggtgaagcatagccatgtcattttaggagtttatcctaagagccatggtaaactattgaagaattttaaccagggtttggcatgattatgtctgcattggttacactgtaaagaatgtctggagaaaaaaccaagtagatcagaggaacccaaagagcaggctcttttggtggtcttggtgaaaggatcagtaagtagcttggattaagtttgtagtgctagtttaagtggaaaggagtcatatttgaaatatatttgggaaataaatcaccaggacttggcgatagataggggtatggcagctgagataaatggagttgtcagagatgacattgagtttgtgcatctgaatggtgaatggtgacatttactagaagaggatgttttttcatagattccgacgttatctttgtgtataataagtagaattattctgagacattcaaagggagctatcatatagtaggcagtggatataaagtttagatttcagacagagagatcaaaggtaaagatgtaaatttgttgtgagacatttttgtgtacgtgattgggtgtggatgagatcatcttgacagacagtatggtggagaagattaatgttctgagactgaaccttaaaactgccaagatttcatagttgagtaagaagttaaggttgaaaaccaacaaaggaggtgtagccagagaggcaggagagaaaaacaggacattacagtgtcatgggagcgaggggaaagagtgcttcaagaagaaaagtagtggtcaacagtgctgaaaggtcaggtgagttgaagcctgaaaagtcacctttggtcttagcaaaatagctgtcactaatgaccttagcaggagctgctttcgtggagtggtggggccacactgcagttaaaagagggctaaagagtgagttagaggtcaggaagtagagggggttagtacaggtgatactgcaaaggttggccaggaagaagacaggagagatccagtgagggacttgttttttgtttttaaatggtagacttgaacgtacttcaatgggatatccagtgggatatgttatttccaagaatttattattctaaaaataaataaattaattaattaatcacctttggaggatcctagaatgaatcctaatgatacttaaaatcaaaatatcattagtcacatggaggttgaaaactgaaaaataaagatccaagcaggtatcctatcttttcaaataggtaacggggaagtttctctttatagaaatgttccagccaataaaccaagcaggaatgacaagaattagagtatcaccctttttgcaacccctgatgtaataacagatttaagtaataatcagaaatggctgctaatgtcaccaaagcagagacaaccagacattaggtaaaagtttgtgacaacttatgatgtcttctggccaaaaaaaatcaaactgaatagtcgggcatggtggctcatgcttgtaatcccagcactttgggaggccaaggtgggtggatcacctgaggtcaggagttcaagaccagcctggccaacaatggccaacgtggtgaaacccgtctctactaaaaatataaaaaatagccaggtgtggtggcaagcacctgtaatcccagctacttcagaggctgaggcaggagaattgcttgaactggggaggtggaggttgtagtgagacaagatcacgccactgcactccagcctgggcaacagaggaagactccatctaaaaagaaaatcaaactgaaactgttcagacctctagatctagataccaatttacaagagaaaaagagaatagaggaacatgttaaacaccaccataggggtactgtcagcaaaatctagactgtgggaaactataggacaaatgactggtgtttttttttttttaacaaataaatagcaatgacaaaaaaaaaaaaaaaaaaaaggtgggggagagagggaagagaacctgcatattaaaagagagttaaagaccagtcacccagttccaacatacagatcttaattcaatcctgactcaaacacataaacctttttttttaaagcactagtgaaacatttaaaaatttttgagcactgacagggtatctaatgatactgaagaattacttaaaaaaatgtttaagtgagataaacagtgcaatgcaatggttatgatttaatagaaaaatccttactttagtgatacatgctaaaatgtttacatattaaatgatttgctacccaagatatacatcacaataatcaaggatggatagggaaatttggtaggatagagatgaaatgagattggccatgaattgatcattgtttgagcttgataatggctacattggagttgcattatgcatttttctttattgtacatctttggatttttttataagtttttttgttattgttctgggatttagccatttgagaaagagataagatccctcgtgtaggataggcattgtttcaaactgtgcgtatgaaatcagtgcattgaattgcaattagcattttggggtaatacttcctagatagtgctttgtgttccacatcatggcatatcagggtgcaaccaatgtccagttgacccaaataagctttttttttttaatgcagtagaatggagtagaagaaaaagtatcaaaatcattaatttatagcatgtggcacagaggtggagttatgcaataagaaggccattacatttctgtgtcatcagtaatgacatagaaattataatgttattaggagatgttaacattggcccaataatgagatttaaactctgttgtgctaaaaacatatgtatatataggacaagtcacccagttccccatatatgtgtgtgtgtgtatatatatgtatatatatgtgtgtatatatatgtgtatatatgtatatatgtgtatatatgtgtgtatatatgtatatatgtgtgtgtatatatatgtatatgtgtgtgtgtgtgtgtgtgtatatatatatataattttttttttttttgagacggagtttcgctcctgtcgcccaagctggagtgcaatgacacgatcccaggatcccagctcactgcaacctccgcctcctggattcaagctattttcctgcctcagcctcctgagtagctgggattacaggtgcccaccaccacacccagctaatttttgtatttttagtagagagggggtttcgccatgttggccaggctggtttcaaactcctgacctcaggtgatccgcccgccttgacctcccaaagcactgggattacaggtgtgagccactgcgcccggccaaaaacatatttttattaaaaccttagtgcactgtagttttatgctagacgttagggatacaaacctgaataagataatttacctgtctttaaggccatagggcctgtgtccctgcatattcttactgagtatgccaagaaagcccctgtctttaaggagctcaagtgcagtaagggagatggagaagcaaatctttacaattcggtaagaccatgcaatgctagagaagtgtatgtgtatacgtgtttatttgcttgctcattccttcattcatgtttttcctgtcatcttccagaaaggaatgagacagcttgcagaaaattcaaaatagcttaagtgaataaataaggatgagggcttaaaatggagccatgactgaggcttaaaacatcaatgcccaatactgctgtggataagccataaatctggttcaaaggtttccacaaagctaaatttgttcagttaaatagttcacagtgcccagaaagccaaatgaattaattagttaagaaggcaacttaaaacaaatttttattgtgtttgacagcaatcttttagtaataaaatcagctagaagaatatattgggtagtatcacacagactaggttttattgggtcccattggttacagtttaggaaacaaatgtttgattatattattcttggatcacaggctccactgagacagaaattgtgcttgttctgcacaccttttatcccctattcctagtactaagtagatgtgcagtaaatatttgtttaaaaactgacaataaaaactgtaatataaataagatgtgttgacataactctgtttcttagtccaaatttctggaatctgaaggaaacatccccttgtgattcaaacaccatctaaaatagtatattggagcttaactaagttttgccacaggactcaaaaagtcatcaaatttctatgtaagtttcggtcttataaagaaaacacttaagtttaggtatgtggcaggataaattattaatacacaggaaagagcaaaagttccagtgtcatggagattagtctgtcctgacaacactctgtgtaccagtgcacctttgtgatgctgagtaagaggagatttgcacttcacgaaggtccaggttaagcttagttgctcagtctggactctggtccctaaagtgggaagtctcaggcaaatctgagtatcagaccatgccggcaattcagctctcttcacctgcttctctctctgcaagatgggataatcatgatacttatatttcagggtgttgtcatgtagtttaaataatgcatataaaacaatctagtacctgacatatagtagttccttggtaatattagttacaattttaagtcccatctctatgacactttgaccatttcattccacaatgatctgttcacggtaaactcctaatgccctatttatttggactcagttatttcagtgtcttatttcagtatctatcttagttcataactggttatcctatgccatcatgctatttgttcactatttgagggaaagaactctactccattgtgtattccctgccccactcaggatggcagtaagtacagctactaatataaattaaagtcattcagaaatgaaattattttcacatttatattacattgttttcacttcatcctggaagttatcattagtctgaaacaaacccagagatactgatcccatatttcaaaattgaccacaactttaaagcattaattaattaataaagaattacacgtgccagtttaaaaagaaatatgcagattatagagatttaaatactgaaatatgggacattttcctgtgctctgccatttgagtagctgttagtttatcaaccttcaggtcatgtttatagaagcactctgccacagggcctgtgtccctgcatattcttactgagtatgccaagaaagcccctgattgctttttacatgggccacttatttgtcaaagttgtgcttgcagcaaacaacctggagggataagttaattctccccttaaagaggaagcttgcttcccttgttgtatgcacagcatccatggtacatcaccctcacaggacttgggggctaatgtaaaccaacatgagtaataaagtcctttgtctctgacccagtggccttgtgtcttctgccgttatctgtgaaaccagtggtattagggtaacctgttagcttttaagcagagtaaaatcctagacttcacacagtttttgataggtcaataggattctcagatctcttgctaatattaattacctgcaaaatgtgagtaaaccggctgtgtatgggaaagaataggggctttagatctagaaaactcaagattctgtacaagttctccagcatcctggccatgtgcaagttacttcatccttctagaaccctgagagaagtactgtgccatagtcaagagaatcagacatgttatacttgagcacaaatcttgcttttcccttttaacaactatgtgacctttttcaaattactacttctcagtgtctcagttcttttcctgtaaaatggagttgatactgctaaccctcatatattattgtgggaattaaataaagtacatgaaaatgccagacacattgtaggtacctagtaaattttagttttttttcttccagattctatgccattagtattttagatttaaaagtctgtcttcatatatgtgtgagtatagtgctcacttttctaaacttagcatcggtttttgcacctataaaacaaaaagttcgataataccgacttcacaaggttgatttgagaataagttttgaaaggatgtgaaatcactatgaagtgcttctcttagttgttctcattgaaagaagttgaccaaatctaatctccctgacactttccctcttggagcactgtggccataatagaattgagaatccaggaacctagaggcaccacccacacagaatgggataatggcagtgcctttccttctgttcctcaggaagtggctggcatggaaggtggtctcatggaagatgcacatcctcctccatgctgagacatgcctttatctcatgactcaggaacagccttaaggaactggcccaattgccaatcactgtgtgaaagaacaaccaccaaatttgttgtttcagcatagtaggattcattctcaatttattccatcaaacatactagttttttagctacttcgggatatattttgcagtgacttggtcctggtgggtagtgttatgtggaaagatacgcttgttacaatatgtgaaaaagagccagttacaaagcctggcattcatttcacttttgtatgagtaattgtatgtataaatatatgtggagaaaaccatctagatagaaggcttattccaaaataccatgggggatatggctttatggtcatttttcttttacttatgtaaatttttaaatttctaaaataaatgtgtgaaaaaagtaaaacctcctcaccctcacaaactaccagtattggtcaaaatgagatgttttataggaatctggtgaaatgcttacatggtcactgtctgacaactctttttttctggggcaaatatctctttcctactcagggacgtggaatttggggttttaagctttagaccatcctgggcacttcaatatatcagaccttacttgtccacaaagtttttcccagactataagtaaccctagttcttcttcctttaggagttgatggcattctgtctgggagagaatacaagattcatgtatttaattttcataataaaaacactgctcatatggcactcttaatcttcagtgcacattaaattttttttttccatggagctttaaaaaaaatactgatgcctgaaccctacctccagaaatctttttttgttttgttttgttttgttttgtttttattgatcattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtaatgactcttaatgagcatgctgccttcaagcatctgtttaacaaagcacatcttgcaccgcccttaatccatttaaccctgagtggacacagcacatgtttcagagagcacagggttgggggcaaggtcatagatcaacagcatcccaaggcagaagaatctttcttagtacagagcaaaatggagtctcctatgtctacttctttctacacagacacagcaacaatctgatttctctgtcttttccccacatttcccccttttctattccacaaaaccgccatcgtcatcatggcccattctcaatgagctgttgggtacacctcccagacggggtggcggccgggcagaggggctcctcacttcccagaggggcggccgggcagaggcgcccctcacctcccggacggggtggcggctgggcggaggcgccccccacctccctcccggacggggcggctggccgggtgggggctgccccccacctccctccaggacgggggctgccccccacctccctcccagacggggcggctggccgggcgggggctgccccccacctccctcccagaaatcttaagttggactggggcatggtctggaagtcacattttaaaagtgtcccagatgatttcaaagtgaagccaagatgtggaagcacttcctcaagccctcgctggagaaatcatgtgttgaattataaaaataataggtgcttattatgaaatgtaacaggtgtactagggtatgaagtgaaacaaaaacaccccattctccccaggtctaccatgtttctttaggtaacatttcacaagtctacaagtatacatcttttcttttctaaaatggtatcatactaagcattactattgtataacttgcttttgtttcctaatatgtgggagacatatttctctatcagtttatacagattagtcgtgctctttttaatgactgcagtgtatctggagtacagatactccttgatttctttaacctctgagagctccgtctgggacagactgccctttagtatatgggacatgttccctatccattccactgtgctcccacatcttcctgttgttaccactggaaaggaatctacatggactacattaaattttatccctaggatataattatatcccattaaattatatccctaggatatagtttaatattacgcccttgtagctttcattgattttttatgaaataattcagacgtataataatcctccatgcaccttctaccctactaaagaaataaaacactacaatacaatcgaacctctaatcctccctaatcccattgccctctaccctatccatagtaactaactggttgtccttgactttggtatccatcccatgcatttctctacatttttactcactgatgttttttgaaacaatgcatggaagtatttggtatgcttttaaactttacacacagtgtatcacactatattcttctgtaagtggctttttcccccctcagtgttatatatttataaaattcatatgggtacatatactttgagttcattaatttttccctaattatgatagtttattttatgaatatattactattccctcatttttcttgatatgatgccaattttttgcaaatataaacagtcatatttgtgacttgtctcatactcaactcctagtgcacacaagggagtttttctcaatctaggagtggagttgttggattgtaaggaacatgtgtctttcatgatctccaaggaggctgtaccagcttagaatcccaccaccagtgtttaaaagtttgttctcatgcttaaaatagattagaataagaaatgttcatttgatgatatttctatatattctccaaaattgctcataagaacattttcatttttattacttaatgtccttcacatgaagtgccatctggtaaattatttttttgttaatgctagggacattttttctctccatgtgcatactgtgcctgtttacaaaaagatttgaagcaatttattggccttttctgacaaactgccaggcttcctgctatcagccagtggctgcttcctctttaattcctttttgtcttggctgccaagacagcaagagctaaactcaaggctcaggtgtggaaacaaatttggcttagttttccccttcgcttcttttatgggagtatttctctagtgtcattcttagaacagctgcatcagaatcttggcggtgctagttaaaaatgctacttactaagccctttcacacatctttttaattggaatctccaaggtggtacacaagaattagcattttaaaagctcatgctaagcttaaatgtaagaatctactgtatggcttgtaatcttagtttcatgtaattgtttcattagaatatgttattgtaaatcacttcaaatgctttttgtactcaatggaaaaaatattaaaatctagcagaatgagatatttgcataagatttagctccaagctgtatctgtaaatagattctattatcaattggccatttagaacactaggtttaaatctgtggattccataaatattcattgagtgcccactatgtgctatacagtgtgcaagaagaagaagtaaatggatgaaacgctataaacagacaggaggttaggaatttttttttttttttttgagatggagttttactcttgttgcccaggctggagtgcagtggcataatcttggctcactgcaacctctacctcctgggttcaagcgattctcctgcctcagcctcccaagtagttgggattacaggcatgtgccaccacgcccagctaatttttgtatttttagtagagacggagtttcaccacattgggcaagctggtctcgaactcctaacctcaggtaatccacctgcctcggcctccagaagtgctaggattacaggtgtgagccaccgcgcccggcctccagaatcttttatctgaatactataacctcacatgaatcttttcctgaataagaagcagatttttttaaaaagtagagttttggcaaacacatacatttgtttctaatggatatatctgtgcattatgatatgtgtactcatcgatgaaatatttctagacccatatttccaaggatcattaacatccttgaatgcatcactgagataagatctgtttattatcttgatgaatataaacttaaatctcatctagccttttagactcagtaattaagttttagaaaagcaatgaattattaagtctcattagaaaacagtttgaaaaaagcaaaacaattggcctcttctctcagcataatttatttctattaaacgttggtgattaagcgttgatgaaaagagatatttactcgatgtggcccatagctaacaattttcatgccatgctacttacacaaactccctcttctgacacccagcttcagggaattctgtgtactcagagtggcacgagtgtgtttttcttgaaagagaattggaagataatagacattcaagtacttagtaacttatttgtttgcccaacttagtgtaattcagaaaatattgagcactgactgtggagtatttgtactctatacaaaatatattctttatggacagaaagaaaacatcttgaatcagtccacaccttctaattagttgtaaataccagtactaaaatccacatgataagtgagcactaaatgagtaagttgttatgattttattggcattaaaaatgtcatcttatcaatatctctgtgctttctttaactgtgtctagcaaacactagttatcttatttcatctttttcatgggaaattattttatgaatttaaggcttgttcctttaattagcttcctcaaagtcacctgaaggtttggtttgatttggttttaaatgcaaatcccaggcaaatcttctgattgaagatcccctggagatagatactgttgtagtaggtatgatgaaggaggcctttagacactatttttttaaaaaagactttaatttttcagagcagttttaggcttacaccaaaactgagaggaaggtatagagagtgtccatctacacttaccactgcccctgcacagcctcccccattttcagcatcccccaccagagtactccctttcttacaattgatgaacctacattggcacatcattaccacccaaagtccatagtttacatgagggctcattgggtaattgataaacaaagtaaatttattacagttctgtagactgggaagtccgaggtcaaggggctacatctggtatgggccttcttactgcctcataaaatggcagaaggcatcacatggcaagggggcttactagagaaaaccaaactggcttttacaacagacccactctagtgaaagtaacccactcctatgataacccattgattcattaccccttaatccattaatccccaaatggattaatccattcataagggcagagccctgatgacccagtcacctcttaaaggccccacttaatactgttacattgggaattcaatttcaatgtgagttttagaggggacaaacattcaaaccacagcattctgcccctggcccccacaaattctatgtccttctcatatacaaatacattcattccatgtttatagccccaaagtctagagtctcatcgaatcagatgtgagtaatgctcaaaggacaattcatcttgaggtaaatttcttacagctgtgagcctgtgaaatgaacgtgttacctacttccaaaataaatggtgggacaggtgtaagacattctcatttcataagggagagataggcaagaagaaaggggtaacaggtcccaaataagtccaacacccaaaggaaaaactaagccttgaggctccagagtaatcttccttggttccatgtcttgcttcctagatacaccagtgtgaggattggatcccagggcctcaggcagccccaccacctaggctttcctgggctctcccaggcttcagttctcacaagtaacagtcaagtgcctgcagctttcccaggctggagctgaatgctggcagttctacagttctgagatctcagcgaggttctgttctctctgctccactagacattaccccacttggggttgtctgtcctggctctggctctgaccccacatttttgcttggcattaatccacgaatggattaattcatttatgagggcagagccctcatcacccaatcacctcttaaatgccccacctcttagtactgttacattggagattaagtttcaacttgaatttcagaagggtcaaaatttgaaccaaagtactgtttatttccttttcctgtcttattgcattaactagtacttccactgcagtgttgaaaaggagtggtaagaggtgacagcttcctattttggctgatcctagttggaaaagcttcaagtttctcaccattaagtatgatgttagctataggtttttttgtgaatattccttatcaagttgaggaagttctcctctattcttaatttactgagagtttttatcatgaatgggtgtcggattttatcaaatgctttctatgcgtctgttgatatgatcatgtgatttttcttctttagccagttgatgtgatggattatgttaactggtgatcaaatgttcacccagtcttgcacacttaggatgagtcctacttagttatggtctgtttttctttttatacattgttggattcattttgctaatattttattgaggatttttgcatctatgttcatgagagatattggcctgtagttttcttataatgcctttgtccggttttggtattaaggtaatgctggccttatagaatgtgtcaggaagtattccctctgcttctattgtctgaaacagattatagagaattggtctaatttcttccttaaatgtttgatagaattcaccagtgaagccatttgtgcctggtgttttctattttagaaggttaatacttattgattcaatttctttaatagatacaggcctattcagattgtccctgtctttttgtgggagttttgacagattgtatctttcaaggaatcagtctgttttatctaggatatgaaatttatggccataacactttacagtattcctttattatctttttaatgcccatgagatctgtggtgatgtctcctcttctatttttaatattagtaatttgtatcctctctctttttttcttagccaagctagaaattattaattttcttgatcttttcaaagaattagcttttggtgttgttgatttttctctattgattttctatttccaatttcactgatttctgctgtaatctcatcatttattgtcttctgcctacttcagatttaatttactttcctgtttctggtttgcccttgaactcttatttttaagaatctctacaagtgactctgatgcacaaatttaggagccattgtttgcattttaatttctaacattttataggaagaaaaacaggatcagagagagattttgttttgcatgaggttataatgtgtgcagtttataaggatgcagcctctggttatattgggttcccctgtattcatcttattgatttatctgattaattttatccatgatgacagattaatcttcctttgacaaccttaattatgtgtagttttcctagctatagttaacattgagtgaaatcatttgctctgttaattatttttctttgcagttcttgggactttcccacaaagtggactactagctatgttagaggatgagttgcccagtcagcacagtgtggattttctttgaaggaaaatacctgtgtccttcgtaagtgtcctacacatgctttatagacagggccagggaacactgtcatgtgagcctgtagaaatttagaatttttctggattgttctcttgattctcatcagtgtttccacggaaattgaaagattgctacagtgggttttgcttgattatatgtgcagtttagtattataacttttataaataaactttaaatactgtagtgtgatcttattgcaatcattagaaggaaggattatatgagagaaacttttttttctattataatacacatgcttctcaagttaaaatgggactatgccctgataaacccatcataagtcagaaacatcataaatcaaaaatgcacttaatactccagtaagctcgttataaaattttaaaataataagtcagggattgtctgtaattttacttatgctaataaatgtttttcatattgctagaagaaggctagttatttctgccttgtcttaacagaatgatacgatataattcttaaatgtatcatttgtgatttttaaaaataacatttgtttttctaattacacaagtaatgcatgttcattatgcaaaattttaaactcaaaattttttaatcacttgtaattccaccacctggagatcattgttgtttaggtagatggctttccaggcttttttaaagtgcacatatgtagtggtaaatcatttgtaatttcattccatttctgagttattgtttatgtttaattaaatacaagacagatttactaattcacgctttttatgccttttaaataccatatggtgcctacatatcttttagtaattggtattctcttacagtctttcctctacttggactttagttttttggggtgtttttcttccttataccatccttcttaaaagttagagtactttgttagttaggagattagctatcttttgtaaaatgtatgtaatatccaaaaaaaaaaaaaacaagctttgacttagacatccattttggacagagttcaaagtttttagcaacctgaagtgaatgggaacatcttcagtttcagaaagcacacaaaataaactaactcttaaaacctctccaggttgggcgtggtggctgactcctgtaatcccagcactttgggaggccgaggcgggtggatcacgaggtcaggagatcgagaccatcctggctaacacggtgaaaccctgtctctactaaaaatacaaaaaaattagccgggtgtggtggcggggcgcctatagtcccagctactcgggaggctgaggcaggagaatggcgtgaacccgggaggcggagcttgcagtgagctgagatcgcgccactgcactccagcctgggcgacaaggcgagactccttctcaaaaaacaaaaaaacaaaaaaacaaaaaaaactctcccatacaaagcacttagaggataaatctatattccacttatatgagatgcctagaataagcacattcatagagacagaaaatatggggaaaggggagagttttccaggatggggaaaggggagagtaaagagttactcttaatggatacagagtttctctttctgtttctgatgaaaaagttctgcaaatggaggcctggcatggtggctcacgccataatcccagcactttaggaggctgaggtgggcagataacctgaggtcaggagttaaagaccaggctggccaacatggtgaaactctgtctctagtaaaaatacaaaacttatacagggtggtggtgcaagcctgcaatcctagctactcaggaggctgtggcaggagaatctcttgaacctgggaggcagaggttgtggtaagctgagattgtcccactgcactccagcctcggtgacagagtaagactccattaaaaaaaaaaaaaaattctgtaaatggaaagtagtgatggctacacaacattgtggatgttaataccactgagctgtgtacctaagaaatgctaaaatggtaaattttattatttttatatatatatatcataatttttaaaagcacttgaagtatgtccaataatactgttgtaataggaataatcattgcctctacttaacaattttaatatttaagctctagttatcattcaatatgaaaagtcctcttttcctaattgcagtatttctcccttatactagcattttccttgcaaaaggcccagagattgtgatttgaagggacagaagcccactccatttgcctgagagacatctagaatattatctcaaaatagtaagatctcataaaaacaaactgtttttcaaatttccatgaaagtgttttttattttagaaactgacccaaaaaagtactaatttcttttttccacaatgctttattaagctttgttgacctatataagggttataggcgaggaggggagtagggggattagaaagattagtcagctgccactcctaaaaatatcagagtgattttttttttccttaatcacataactgtaaccttctgtctactcagggcaaactaactttaagatgaaacctaaagaatggatttttcattttttactacatttgactgtaaatacagacagcttgataataataacatatgctgtggaattccctaaatctctaacatattttaacatcattgtctagtatagtatgtcttataaatgattgttgatttaataaaaactataaactttatttatttttttgtttttttgttttgagatggagtctcgctctgtcgccaggctggagtgcagtggcaccatctcggctcactgcaacctccacctcccgggttcaagtgagtctcctgcctcagcctcctgagtagctgggactacaggagcgtgccaccacacccagctaatttttgtatttttagtagagatggggtttcaccatgttggccaggatggtctcgatcacttgacctcatgatccgcccacgtcagcctcccaaagtgctgggattacaggcgtgagccacctcgcacagccaaactttcttgttaatgtatatcttgtcttgcttctaaaactgattttaggcgtgagccactgcgcccagccatcttaggcactttactgagatatttacaacatagcagaataataagagaagagaatggtatcaaagactctggatcagagagaaaataagaattgaattatgatataaagccaggtataagatgttattcagttgttttctagtaatcaagctagaataaataaactatacatttcttaaaggaaattaacaggaaatacgtttatcaataaacagttcccacaattataaatgcatacttccccagtagccttgatgactggttcatgagccagtatttcttcagtgtgtattcagcattgctacttccattggtactacatccgtaccatcaggtgctatggaaaaatagaattgtaatagaaaatgtgttggctcctaatgcagtggccttcaaactaccctccagggtgtgagtcccacagagccgcctcagaataacaggcctaatagtcctgggttcttaaccagagcaaacatcattcattgtatctaatctgcagagtgaattttcttataaaatattaaatattttatattaaaatatattttaaatatttaaaaagttctacaaatggaaagcagtgatggctacacaaccttgtggatgttaataccactgaactgtgtacctaagaaatgctaaaatggtaaattttatgttatatatatttatcataatttttaaaagcacttgaagtaagtcaaagaatcctcctgtaatagaaataatcattgcctctacttaacaattttaatatttaaactctagttattacattttaaatataattaaaatatatttttagtttaaatacttaataaaaataaatacttaaaatatatataaatataaaataataatacttaaaaataataaagtaaaaatattatttgaacaaaggatttaacagctaaaaagatattttgaaacctctgacctagtactagagtcaagaccattgcctaataaaagtatgtccaagatctcctgaacactggcctgccctccttaagaaagaaaccctataataccatgaggcatgtaggggtgactcaaaaaactccaggccagaaaccagaacacctaataagtatttgtctcttgtctgccacagattagccctgtcaccttgaggaagtggcttgacctctgaaatgtcttatctcatctataaaataggagtataaaatgattactaagaacttgtccagcaccaagactttttcaaaattctttctcttgcctcaaagatggcaaagaatgtgccatcagacaagctcttcccttctgtcaaaagagaagaaccattggagaaagaaatgaccaaattctatgtagagagcttgagcaagaagaaaaaatgtaggggaagggtaaatagctctgtctagagcaattggcttttgttgtttacagcttgtctatgtcagaccatcccgtaggaaaagtttggtaagaacaaagacctttgataaaagatgactgagagactgtctggggtttgatgcaaagatcatcagaggcatctacaaatgagtagtcaccagtgacaaaatctcaaagcgaggcaggctggagaatgggcgatctgttagtcttgccagagaggaaggtattagcaaaggcagattgaataagcggaaggtaaaaaaataaaaagcagcaatagcattttttttttacatatacttcattagcacaggtttggctttaccaatataggaaaggcatttttacactaattaggtcattgtgaaaaagaaaaattggagttattttttaaatgcagtgtttttaactaagaagaaaatatgagaccgggtatggtggctcatgcctgtaatcctagcactttgggagcctgaggtgggtggatgacttgaggtcaggagttcgagaccagcctagccaacagggtgaaaccctgtctctactaaaaatacaaaaactagctgggcatggtggcacattcctatagtcccagctactcgggaggctgaggcacgagaattacttgaaccctggaggtagaggttacagtgagctgagattgcaccaccgtactccagcctgggcaacagagagactgtctcaaaaaaaaaagaaagaaaatattaatactgtggaggttatgtgacagtctttaataacaacaaccagttatattactataataagctttccatgaaaacaccaaaaagtactttttgatatcttattaaaaattaagattctgtcatatttcttagaattatatacattataattttatgttttttagaataaactcagcaatactgtacaaggatatcgtaatctatatggaagcacaaaggaacatataaatttaaatccttttgctccatgatcagtcacttcttttcattttaaactttaattttggacattcacaaaattgttaactcttgagtgatgtggattgagtaagttgtattacaattgtaaaaacaaatgattcatttcaacttgtattgaacatcttatgtgcaagacactctgcttaacacttgaggggactacagagataaatcagtgaggtcagttctatgggaggggaatcagggacagctacacagaagcagcttaaggatgataaggcttccagtccacagaaagagaggggtgaagatgattccagtataatggaaccatgagaacacacagaggaataaaggtgtgtcacatcagctctttgaatatgccacaaaaaaaaaaaaaaaaaaaaaaagctctgaattagttttccctcagtatctgctggggactggtttcaggaccccccagtatgaaaatctgcagatgatcacatccctgatataaagtgggatatttgcatataacctgtgcacatcctcctcgatactttaaatcatctccaggttacttagaatacctagtgtaatgtaaatgctatgtaaagagttcctatactgtattatttttaacatttatattattttgtattgttttttatttttattgaatattttcgatccacagttgattgaatctgcggttgcagatacggagagctgattgtataccctctaaaaggatgaattttatgctatgtcacttatatcttaataaagctattatttttcaaaagtacatgccgtgtgttagagatggcaaggataaattgttgtcatggtgacatgggatcctgtgttgtgcagaaggagaggagactggagagaggtgtaggatcagaccacacagagggtcttgaaaaccatgctaggaattttgaattttattttccaggcattagtaaaacattgtaagtttttaagcataggaatcaaaatgactccattgattttaaaatacggagctaaaagataaattagctgttagtaaaagtgaaggtggagaggaaaaactaggctattggaacagcttcgaccaaagagtgtaaattagtgaaactagtttgcaagaatactagggacaggggtcaggcacggtggctcacgcctattatctcagcactttgggaggctgaggcaggaggatcacttgagctcacaagttcgagaccagcctaggcaatgtggcaaaaccccatctctaccaaaaatacaaaaattagccaggcatggtggtgcacgcctgtggtcccagctactcaggaggctgaggtgggagttcgcttgaacctgggaggttgaggctgcagtgagccaagatcgtaccattgtactccagcctgcgtaacagagccagaccttgtctaaaaaaataaaataaaaatgctggggactggatattgcatcttaaaggggcaaggaaaatgaaagaaaatgctgaattctcattttcatatttatagaacaaagatactgtattatttttctgaactgtgtaaccaactatcacaaatttagcagcttgagcaacacacatttattatatcaacatttctgtggttcatgaccccagacacagcttagctagggttgtgtgaggctgtggttaaggtattggccagggtgggattctcaccttgagtcaggactagagatgcatccactttcagaattacccaggttgctggcagaattcatttccttgaggttgtgagtctgaggtcctcagcttcttgccagctgtaggctggggactgctctcagctcctagaggatgcttgcagatcacatggccctctcaacatgacagtgaacttcttcaaagccagctggggagaaagtctctagcactagttgactggcaaaacatacaacatcatataatcgtgaaattaatatctcatcacctttgccatagtctgatggttcaaagcaagttacaggtcccactcacaataagaggaggaaattatccaagggggtgaacaccagaaagtggagatggttggggtcactatagagcatgtccaccacaggtacttttcagcctcttaaagtacagtagagtgtcctctaaagccgagtgagcagagtgtagactctggcgtcagaccgagccaggtttgaatcctgactccatgactgactatccttttgagcactaaacctcagtctcctcatttgtacatagggataaagatctacgtctcatgatgtggtgtcaggacaaaatgagataatgccggtaaaacacttcagtgagtgcccaagacaggaaaattgctcacatatgttatcacatttgagtctcagctaccatgagaagtaattgaaaagttttccattaaatgatttacctatattaaatcagtttttgctcttgagtaaacttaatctaatggactttttgctatatcattgtgagcatggattaatacattcatgaaaaatcactagacttgagtagaggattttttttttaatcaacctcttctttttacagacaaggaagctacaaccacatagaaaagttatccgacttgcctaagatctcacagtacttagtggctaagccaggactagagtgatggcctatttatgcaagttactgctgtttctaccatgtttagctgtgtgacataaatttttaattacgacatttatacattttttcactcaatcttgtagactagaagctcctttttcaatgagacagctaattttttaatgccaagaaatagatacatagaaaagttcaaggccttagccctaaaataagaatttgcaaacttctagtgacagtactcaatctctctgaatgtctctattgtttaagacgtgatctgatgttttaactttaaattaaactaaattggctgggtgcggtggctcaaacttgtaatcccaacactttgagaggctgaggcaggcggatcacttgaggcgaggagtttgagaccagcatggccaacataccgaaaccccatctctactaaaaatacaaaatattagccaggtgtggtggcgtgcacctatagtcccagctgcttgggaggctgaggcgtgagaatcacttgaaccctggaggtgaaggttacagtgagctgaaattgtgccactgcaatccaacctggacaacagagtgagactctgtctcaataaaataaaataaatttgctacttatatgtgtatgtgtcttcacactgtatatctgggcacgctctatattttttgaaccgattcttaagggtatcccaatgatagtaatgaaaataagcagcatgaaattttatagccatcctagaacaatatttcctgtgtattttaatccactggaattgggaaagaaggattgattatgttgttttcatttaatgtccatttatcaatctccatctttgtgtcagatgtttgctaggtgcttgggggatgagaaagggtcaccacatgaccataatcctcctacccagagataactactctaaacatgttgatagccttctatatatattttttgcacatgtagtttttaatataaaaagtgacacaataaaatactttcaaaaattataattacagaagcagtggctgtcatggtaggaggaaactaaagcaaatcagagggcacaaaactgaaaactaggaggattcccatttcctcccaaccccctgctaccctccccagccctactcactagaggcaaccactgagtggtccctgattttcttctggtagttaacattatattcatataaaatattttaactctggttttagatttattagctttagacagtatctgttaaccttttgctataaaatatgaagaaattttttatcaattcaagcttgagccgttcttcttctcagcttccagtttctaaaactgtttttaccttgaaaaggtctctgacatttattattactggtgtattatctcttgtgctttttcataggctagtttaaaaatggaatgcattattgtgatcacatgttacatgtgtattctctttagagctaaatatatatgtatatcattctaaggtactaaactttgttgtttgacaaacctgacaaaacaagcaatggggaaaggaaaggggaatcttctaggcatcccagtctaaaactcttcatttctatccagcttttttcacttcttccatttcgactgctactcttccttgtatctcatgttattatcttccttgaatattcttttttttttctttgctctgttgcccaggctggagggcagtggcataatctcagctcactgcaaactccgcctcccaggttcaagcaattctcgtgcctcaacctcccgagtagctgggattataggcacttgccaccacacccggctaatttttgggtttttgttgttgttgtttttattatactttaagttctagggtacatgtgcacaacgtacaggtttgttacataggtatacatatgccatgttggtttgctgcacccatcaactcgtcatttacgttaggtatttcacctaatactatccctcccccagccccctacccctaacaggccccggtgtgtgatgttccccgccctgtgccaatgtgttctcattgttcaacacccacctatgagtgagaacatgcagtatttggctgcatagtattccatggtgtatgtgtgccacatttttttttaaattttaagaaatgctctttttttttaatatactttaagttctagggtacatgtgcacaacgtgcaggtttgttacatatgtatacatgtgccatgttggtgtgctgcacccattatcttgtcatttacattaggtatatatcctaatgctatccctccccactccccccaccccacgacagaccccggtgtgtgatgttccccttcctgtgtccaagtgttctcattgttcagttcccacctatgagtgagaacatgcagtgtttgattttctgtccttgcaatagtttgtgagaatgatggtttccagcttcatccatgttcctacaaagtacatgaactcatccttttttatggctgcatagtattccatggtgtatatgtgccatattttcttaatccagtctatcattgatggacatttgggttggttccaagcctttgctattgtgaatagtgccacaatgaacgtacgtgtgcatgtgtctttatagcagcatgatttataatcctttgggtatatacccagtaatgggatggctgggtcaaatggtatctctagttctagatccttgaggaatcgccacactgtcttccacaatggttgaactagtttacactcccaccaacagtgtaaaagcgtttctgtttcttcacatcctctccagcatctgttgtttcctgtcttcttaatgatcattgttctaactggaatgagatggtatgtcattgtggttttgatttgcatttctctggtgaccagtgatgatgagcattttttcatatgtctgttggctgcatgaatgttttcttttgagaagtgtctgttcatatcctttgcccactttttgatggggttgtttgtttttttcttgtaaatttgtttaagttctttgtagattctggatattagccctttgtcagatgggtagattgcaaaatttttctcccattctgtaggttgcctgttcactctgatgacagtttcttttgctatgcagaaactttttagtttaattagatcccatttgtcaattttggcttttgttgccattgcttttggtgttttagtcatgaagtccttgcccatgcctatgtcctgaatggtattgcctaggttttcttctagggtttttatggttttaggtcttacatgtaagtatttaatccatcttgagttaatttttgtataaggtgtaaggaagggatccagtttcagctttctacatatggctagccagttttcccagcaccatttattaagtagggaatcctttccccattgcttgttttgtcaggtttgtcaaagatcagatggttgtagatgtgtgatgttatttctgaggcctctgttctattccattggtctatatatctgttttggtaccagtaccatgctgttttggttactgtagccttgtaataaagtttgaagtcaggtagcatgatgcctccagctttgttctttttgcttaggattgtcttggcaatgcaggctcttttttggttccatatgaagtttaaagtacttttttccaattctgtgaagaaaatcagtggtagcttgatgtgggagatagcactgaatctataaattaccttgggcagtatggccattttcacaatattgattcttcctatccatgagcatggaatgttcttccatttgtttgtgtcctcttttatttcgttgagcagcggtttgtagttctccttgaagaggtctttcacatcccttgtaagttgtattcctaggtattttattctctttgtagtaattgtgaatgggagtacactcatgatttggctatttgtctattattggtgtataggaatgcttgtgatttttgcacattgattttgtatcctgagactttgctgaagttgcttatcagcttaaggagattttgggctgagacgatggggttttctaaatatgcaatcatgtcatctgcaaacagggacaatttgacttcctcttttcctaactgaataccctttatttctttctcttgcctgattgccctagccagaacttcccatactatgttgagtaggaggggtgagagagagcatccttgtcatgtgccggttttcaaaaggaatgcttccagtttttcccattcagtatgatattggctgtgggtttgtcataaatagctcttattattttgagatacattccatcaatatctagtttattgagagtttttagcttgaggggctattgaattttgttgaaggccttttctacatctattgagataatcatgtggtttttgtcattggttctgtttatgtttcggattacacttactgatttgtgtatgttgaagcagccttgcatcccatagatgaagctgacttgatcgtggtggataagctttttgatgtgctgctggatttggtttgccagtattttattgaggattttcgcattgatgttcatcagggatattggtctaaaattctctttttttgttgtgtctctgccaggttttggtatcaggatgaggctggcctcataaaatgagttagggaggattccctctttctctgttgattggaatagtttcagaaggaatggtaccagctcctctttgtacctctggtagaattcggctgtgaatccgtctcgtcctggactttttttggttggtgggctattaattattgcctcaatttcagaacctgttactggtttattcagagtttcaacttcttcctggtttagtcttggcatggagtatatgtcctggaatttatccatttcttctagattttctagtgtatttgcatagaggtgtttataatattctctgatggtagtttgtatttctgtgggatcggtggtaatgtcccctttatcattttttattgcgtctatctgattcttctctcttttgttcgttattagtcttgctagcagtctatcaattttgttgatcttttcaaaaaactagctcctggattcattgactttttgaaggattttttctatctccttcagttctgctctgatcttagttatttcttgccttctgcttgcttttgaatttgtttgctcttgcttctctagttcttttaattgtgatgttaaggtgtcgattttagatctttcctgctttctcttgtgggcatttagtgctataaatttccctctacacactgctttaaatgtgtcccagagattctggtatgttgtgtctttgttctcataggtttcaaagaacacttttatttctgccttcatttcattatgtacccagtagtcattcaggagcaggttgttcagtttccatgtagttgtgcagttttgagtgagtttcttaatcctgagttctaattcgattgtagtatggtctgagagacagtttgttgtgatttctgttcttttatatttgctgtggagtgttttacttccagttatgtggtcaattttagaataattgtgatgtggtgctgagaagaatgtattttctgttgatttggggtgtggagttccgtagatgtcttttaggtccgtttggtccagagctgagttcaggtcctggatatccttgttaaccttctgtctcattgatctgtctaatattgatagtgggatgttaaaatctcccattattattgtgtgggagtcttagtctctttgtaggtgtctaaggacttgctttatgaatctggatgctcctgtattgggtgcatatatatttaggatagttaagtcttcctgttgaattgatccctttaccactgtgtaatgcccttctttgtctcttttgatctttgttgctgtaaagtctgttttatcagagactaggattgcaacccctgctttttttttgctttccatttgtttggtagatctgcctccttccctttattttgagcctatgtgtgtttttgcacgtgagatgggtctcctgaatacagcacactgatgggtgttgactctttctccaatttgccagtctgtgtcttttaattgtggcatttagcccatttacatttaaggttaatattgttatgtgtgaatttgatcctgtcattttgctgttagctggttattttgcctgttaactgatgcagtttcttcatagcgtcaatggtctttacaatttggcatgtttttgcagtggctggtactgattgttcctttccatgtttagtgcttcctttaggagctcttgtaaggcagacctggtggtgacaaaatctctcagcatttggttgtctgtgaaggattttacttctcccccacatatgaagcttagtttggctggatatgagattctgggttgaaaattcttttctttaagagtgttgaatattggcccccactctcttctggcttgtgtggtttctgccaagagatccactgttagtctgatgggcttccctttgtgggtaaccggacctttctctctgactgcccttaacattttttctttcatttcaaccttggtgaatctgacaattatgtgtcttggagttgctcttctcgaggagtatctttgtggtgttctctgtatttcctgaatttgaatgttggcctgccttgctaggttagggaacttctcctagataatatcctgaagagtgttttctaacttagttccattctccccgtcactttccagtacaccaatcaaatgtatatttggtcttttcacatagtcccatatttcatggaggctttgttgatttcttttcactcttttttctctaatcttgtcttctcactttatttcattaatttgatcttcggtcgctgatatcctttcttccacttggtcaaatcggctattgaagattgtgcatgcatcatgaagttctcatgccgtggttttcagctccatcaggtcatttaaggtcttctcgacactgtttattctagttagccattcatctaaccttttttcaaggttttcagcttccatgtgatgggttagaacatgctccttttgcttggagaagtttgttattaccgaccttctgaagcctacttctgtcaactcatcaaactcattctctgcccagttttgttccattgctgctgaggagctgcaatcctttggaggagaagaggcgctctggttttcggaagtttctgcttttctgctgtggtttctccctgtctttgtggttttatctacctttgttctttgatgttggtgacctacaggtggcattttggtgtggatgtcctttttgttgatgttgatgctatttctttctgtttgttaattttccttctaacaggccccttaactgcaggtctgttggggtttgctggaggtccactccagaccctctttgcctgggcatcaccagcagaggctgcagaacagtaaatattgctgcctgatccttcatctggaagtttcatcccagaggggcacccgcctgtttgaggtgtctgtcggtccctactgggaggtgtctcccagtcaggctacacggggttttgggacccgcttgaggaggtagtctgtcccttctcggaggtcgaatgccatgctgagagaaccgctgctgtcttcatagttgtcagacagggacgtttaagtctgcagatgctgtctgctgcctttcattctgctatgccctgcccccagaggtggaatctagagaggcagtaggccttgctgaactgtggtgggctctgcccagtttgagcttccaggccactttgtttacactgtgagctactcaagcctcagcaatggcagatgcccctccccctgtcaagccacaacgtcgcaggttgatctcagactgctgcgctagcagtgagcaaggctccgtgggcgtgagacctggtgagccaggcatgggagggtatctcctggtctgccggttgcaaagaccatgggaaaagtgcagtatttggtcaggagtgtactgtttcttcaggtacagtctctcatggcttccctcggctaggaaaaggaaatcccccgtccccttgcacttcccaggtgaggcaacgccctgccctgtttcagctcaccgtccataggctgcacccactgtccaaccagtcccaatgagataaagcaggtacctcagttggaaatgcagaaatcacatatcttctgcatccatctcggtgggagctacagactggagctgttcctatttagccatcttggaagcgacccttaatttttggatttttttctgagacagattctcgctctcttgcccagtctggagtgcagtggtgcaacctcagctcactgtaacctctgcctcccgggctcaagcgattttcctgccttagcctcctgagtagctgggattacaggcatgcaccactacccttgcataatttctgtatttttagtagatatgtggttttgccatgttggccaggctggtctcaaactcctgacctcaagtgatctgcctgcctcagcctcccagagtgctgagattataggccactgcacctggctgaatattttttttttttttgagcctgtctctgagtacttttttcatgtagggctcttggtggcaaatttttttagttttagaaagcctcaaatagctttatcttcatatttgctttgaaagtttagatgaatataaatatccagattttaaatttaaagaaattgctcccgttatcttccagtattacattcaatgtagataaagtcagtaagagtctgattctcatcccttgcttaatgatgaattttttctttctctgaggcatttagaattttttaatccttattataaaattttcagcagaatgtttagatgtaaatcttttcttactaatcttactcagcatttcatgaaaccttcccatatgaaggtgcatgtcttatttcagcgtaggggcattttcttaagttattttatgtcattacctttgttgtttgtatcttttgcacttcctatttgagcagctttcaactgttaggacatggtctccgtgttttaaatctatttgtttgtactttacatttcttggtctttctcattgctgttctcagagatttctttgaatttatcttccaggtttaaaaacttggtctagggcagggcacagtggctcacgcttgtaatccaagtgctttgggaggctgaggctggtggatcacttgagcccaggtgttgtgaccagcctgggcaacatggtggaaccccatctctactaaagatacaaaaaataaaaaattagccaggcatgcctgtagtcccagcttcccagcaggctgaggtgggaggatcatctgagcacaggaaggttgaggctgcagtgagctgtgttcatgccactgtactgcagcctgggcgacagagttagaacctttctcaaataaacaataataaaataaaagcttggtcctatacagcatcgaattttaatttcacccatacagtaaatttttcagtgatcatatttttaattttcaagatttcttgttctccagttgtttatttcttcatagacttttcttgttttaagtctgtcatattcttaatcttcctgaggataccaaatcgagattttgcttgttttaattctttccagttctattagtccattttcacactgctgataaagacatacccgagactgggcaatttacaaaagaaagaagtttattggacttacagttccacatggctgggaaggcctcacaatcatggcagaaggcaagggagagcaagtcacatcttatgtggatggcagcaggtaaagatattgtgcagggaaatgcgcgtttttaaaactatcagatctcatgagacccattcactgtcatgagaacagcacaggaaagacatgcccccataatccagtcatttcccactgggtccctcccacaacacgtgggaattatgggagctagaagatgagatttgtgtggggacacagagtcaaaccatgttattccacccctggcccctcccaaatctcgtatcttcacattcagaaccaatcatgccttcccaacagtcccctggggtgttaatttatttcagcattaacttaaaagtccacagtccaaagtctcatccaggacaaggcaagtcccttctgcctatgagcctgtaaaatcaaaagctagttagttacttcctaaatacaatgggggtacaggcattgggcaaatacagccattccaaatgggagaaattggccaaaacaaaggggctacaggccctatgcaagtctgaaattcagcggggaagtcaaatcttaaagctccaaaatggtatcttttgactccatgcctcacatccaggtcacactgatgcaagaggtgggttcccatggtcttgggcacctcctcccctgtgctttgcagggtacagcctccctcccagcttctttcacaggctgacattgagtgtctgtggcatttccaggcatatggtgcaagctctaggtggatctaccattctggggtctggaggactgtggccttcttctcacagttccactagatggtgccccagtagggactctgtgtgggggctgtgaccccacatttcccttctgtactgccctagcagaggttctccatgagagctctgccctgtagcaaatttctgcctggacatccagttatttccatacatctctgcaatctaagcggaggttcccaaacctcagttcttgacttttgtgtacctgcaggctcaataccacatggaagctgccaaggcttggggcttgcatcctctgaagccacaacctgagctgtaccttggccccttttagtcatggctagagctgctgggacacagggcaccaagtccctatgctacacacagcgggggtctacaggcctggcccatgaaaccactttttcctccttggcctcccggggtgtgttgggaggggctgccatgaagacctctgacatgcctggagacattttccccattgtcttggggattaacattcagctcctcgtttttaatgcaaatttctgcacctggcttgaatttctcctcagaaaatgggattttcttttctatcacactgtcaggctgcaaattttccaaacttttatactctgtttccattataaaactgagtgcctttaacagcacccaagtcacctcttgaattattttctgcttagaaatttcttctcccagatcatcctctgcctaaatcacctctctctagttcaaagttccacaaatctctagggtggggcaaaatgctgccagtttatttgctaaaacaaagcaagagtcacctttgctccagtttccaacaagttcctcatttccatctgagaccacctcagcctggaccttattgttcatatcactatcagcatttttgtcaaagccattcaacatgtctgtaggaagttccagactttctcacattttcctgtcttctgagccctccaaactgttgcaacctctgtctgtttcccagttccaaagttgcctccactttttcaagtatctttccagcaacaccccactcctggtaccaatttactgtattagtccattttcacactgctgataatgacatacccgaggctgggcagtttacaaaagaaagaggtttactggacttacagctccacatggctggggaggcctcacaatcatggcagaaggcaaggaggagcaagtcacatcttatggggatggcagcaggcaaagacagagattgtgctgggaaactcccgtttttaaaaccatcagatttcatgagactcattcactatcatgagaacagcacaggaaagacctgcccccataattcagtcatctctcaccaggtccctcccacaacatgtgggaattacgggagctacaagaaaagatgtggctggggacacagagccaaatcatatcaccagtgaattgtatttttatccacttcctctatggtacttgttctgttggttttctcagtcttctctttcatactgtcatttttccttatgtgtcctcaaatttttctttaatgtgtttgctactcatatatctgactggaacattactcgagttattataatagcaaggatgaatttccagtagctcaataggtcctttttctagcagactcctccactgaagttaaaaaatttctggtgacctcattttttaacattcactatgttattaatataaccattttccgatgccaaaaattctaacatactaattttattggttgcatagtttttcatcatagtactgtttactctttctcttattattggatatttgattttttccagcttttcattaaataacatcaagaacacatttgtacatgtatttcttcatgtatctctgatggttttcatagtgttaattcctagagtgaaatttataggtcatgaaagatttctaatagacattgctaaattgtcttttggaagattgtaacaagtctctgtctcataaaaataccctttccccgcagcactcttgataatggcagatcatgttctttttaatctctgctaacttagcaatatacatattacaatatatatatagaatgtgaatattttcctgtttgaatttacatatttgggtgttttcatgagtttcttttgtgaattgactctttatgttctttgcctgtttttctgttcaccattttgtttcgctttgtcagactttattttgggaatgttaagtgctcattataattactgtaagttttttctcagtttgtggtttgcctttaacttttttattatgtgtcttttgctaaatatatgttttgatgacatatatgtaaagccacccactcacctgtccagagattaaatttcatctatatagcttggtatgtttatgatttctagttttacattaaacttttaaatccatgtacatttatgttggaatatggcttatatagggacacatctttgttttttctgaaataactaattagctagcatctttttcattgactggtagttcatcctttccctattaatttgaaatctcacctctgtcatatacaaaatgttttttataaatatgtgtgtgtatctgcctagaaataacttgtccaggcacatcttacaattcttgacatttctaacaagaccactctgttactttactgttttagaaagcacttaagtataatgcttaatctactgtattaaaactgtatacaacagccaggcatggtggctcatgcctgtaatctcagcattttgggaggctaaggcaggaggatcatttgaacccaggagttcaacaacagcccaggcaacatagtgagaccttgactctacaaaaaatttaaaaattagcttggtgtggtggcatgcgccagtggtcccagatattcaggagtctgaggtgggcactcgcttgagcctgggaggttgaggctgcagtgagctgttatcactgccactgcactccagcctgggtgacagatcaagagcctgtctcaaaaacaaaaaacaaaacaaaaaactgtatccagtgcttgtgtattatcctaatttctaaaaatcaatgaccccccaaaatatttccctcatcagaatgttctgttatcagccaaagatttctttctgtcagctcacatcctgccacaataaaggcaaacagtggtagacagggtgaaccattgtgattctgaagcattctaagtggtttcagggatatgaaagtttcatcatcctgttttgtggtaggggaaaaggaaatattgttaaagtaaacattgaaatttgaggtaaataccagtattcgaactttgaaaaagtagccagaatgttcctaaggtggcaacatttcagaaattatacaatttctcaatgccgctagttattggaacagttctaaggctctgcccatgtgttgacatcacattccatctcccttgttcttatagggcttcagccacacagctggttaaggtgcaatttgaccatgactttcttaagaaatgaaaggtacattatggtgctgtaggtcaaatgtgaagtatgtgtcctattttgtgaactattgtagcaaaactaaatcaatgaagggattttgctgagaaagtagttaccagcattcacaaagctggctactgggtgaaaaacctgaattctgagttttgcaattaactgcataacactgagtattacctaataatgattcctttgtttttttcagttccttttgcattatataggtgttttcccaaatgtgttctgaaagacattattgctgcaaggtgctctggaagacatttcagggaccatggttaaatcagttaaagaaaagctgtgtactagatccttctctaagaaatgcactggctgggcacggtggctcatgcctgtaatcccagcacttagggaggccaaggcaggcagatcacttgaggtttagagttcaagatcagcctagccaaaatggtgaaaccctgcctctactaaaaatacaaaaaatgttagccaggtgtggtggcatgcacctgtagtcccagttacttgggaggctgaggctatagaatcacttgagcccaggaggcagaggttgtagtgagccgagagcatgccactgcactccagcctgggcaatgggaatgaaaccctgtccaaaaaaaaaaaagcacaatatgtagtctcatactaaaggctttaagaagtcttacagaaaagaaatttaaatcttttggatctatttcttgacatctgtaggaactgtttcataaaatctactttaggaacctgtattagctgctgtccaaggtatcaaacgtctataattctagttccagtaaaaagttgtatataaataacttactttatatgtagtactttaatttgtaatatcagtatggaatcttcttaaggaaacactgaaaaaaacctttaattgtacaagatctttgtacagtatcatggacttttaaacacagaaacacagagaagtattgttttgtcctgtgaataccaaaactttgatttggatttattagtgagaaaaaagcaggatcaaacgtttccctactttttaggagttctgtgcaatacctcaaattctatccagaatgttcctacaaagtacagtatgatgttagacactctttacatccaacatgttttcttttgtttaatttaatttgagctattattggctcaaaatatatagattcttagtgatcttttatatttattgttcataaaataatgttcggcttcctaataagaaagtgaagaggaaaatcaaggtgttttcatcttgcttgtaggatgggtgctgcagacaatatatataaaggacagagtacatttatggaagaactgactgacacagcagaaataatcagaaaagcaacatcacagtccttggttatcttggatgaactaggaagagggacgagcactcatgatggaattgccattgcctatgctacacttgagtatttcatcagagatgtaagtatccggtaaactgtatttaaaaagaaattaatttgtaaattattatttttaaatgacagtcataattgtgccatatttatggggtacaatgtgatgttttgaaacatataaacaatatggagtgattaaattaacctaattaacacattcctcacctcatttaaatatcattttttgtggtgagacatttgaaatttctcttagttattttgaaatatatattattactgctgtagtcataataccgttatgcaatccctgcatacccttttgtacatggatgatacatattatacacattattttcctgatctcagtctccaaatactcaaaattatcttttttataattgactgcagtcctgcaagtgatcattagaatgctacacactgaattcagacagattgaccctaaataatgtttgtagttttttgatatatgttcctttttttgctgactcaacataaatctggttgtacgaaaaaggccttcctggcaatattttcactcagaattatatcttattatccttggtgaaccctaaatcaagaacaggtaccatccatctacagccaaattcctcgagggaaaaacaaggaaatagtgccatttccactttgtgaaatcctttttttcaccaacatcctgaaggatctcactgtgagatctttgatctcatctctttgtgtttctatctgattcagtaacatcattccttcaatacatgtctcctttttttcagggtgcatttctaagcttcagtgtaaaattttgtttgtgtcaaactttctatccctgtcatttccatctaactctctcctttagtttactttctctatcttgttcattttggtctctgcttttcaaatctccccttcatggcacctctccttaggtctttcccttctctggtctttctttctgttttcccccccattttcttgctcctttgtcattgtgtcttccctcattttcatttctttctctcttccttaaatagccaataaaatcatatttttaatatttcttttcaaaaagcaacacaaaaataaaatgtatttttctttaaccttttgttgccattggtgttttggggtttagttttgtttttaaagcttaatttccatttaatttttttccagaagatagtttttcttcagtctttagagactcagctccatgaacaggctttgatggagatcatggggcagcatcctcagatctaaattggagcagagttgtttggtcctctaggcttcatgagaatgattcctgactaccttgctgtgagcggcagaacttgtgcagtaatacagtttcatacactgtttgggaagcacagagacatcaacgacactcaatttggaaatgtccctgacagctgtaccttctactatatttcaaatgacaaacttctaaatagccttgtccttaggtgtgcatccaacacagtttgtgcagcaaataggttgtacctagctatggccctttttggcacaaccgttgttgttgttcctcctcctcctcttctttctcttcctcctcctcctctttttttttttttttttttttttcttttttgaaatgggttcactctgtcactcaggctgcagtgcagtggcatgatcatggctcactgcagcctcgacctacctgggcccaggtgatccttccacttcggcctcccgagtagctgggactacaggcacacaccaaccatacccagctaatttttgtattcttttaggaatggagtttcaccgtgttgctcaggctagtcttgaactttcaggctccagtgatccacctgccttggcttcccaaagttctgggattataggcatgagttaccatgcccagcctcccttcttttctttgttattttggcagtgaagacccaagagtgactcaggttttgtttaaacatttatttagattacataggtaattataacattttgttttttttaaggaattttttgttttgctttaaaaaatttatttgcaaaaagatgtaactcagaaactttaatcattatagaaactacgtaggaaatgatgagttcatgtcctttatagggacatggatgaagctggaaacgatcattctcagcaaactatcgcaaggacaaaaaaccaaacaccgcatgttctcactcataggtgggagttgaacaatgagaacacatgggcacaggaaggggaacatcacaaactggggcctgttgtggggtggggggaggggggagggatagcattaggagatatacctaatgttaaatgacgagttaatgggtgcaacacaccaacatggcacatgtatacaaatgtaactgacctgcacattgtgcacatgtaccctaaaacttaaagtataataataataaaaaaaagaaactacataggaaagcaattgacttttgtacattaaccttggatcctgcaaccttgctgtaatcacttactaattccagtctgtgtgtatgtttgccaattcttttgaatttcctacataggcagtcatgtcagatacaaacagacagtttcacttctttcttccccatctattttttttttcttgtcttattgcagtaactaggactttcagtacagtgttgaaaaagcagtaagaaaggatatcgttgccttgtttctgatcttagtgggaaagctttgagtttctcaccgttaagtatgatgttagctagaggttgtttgtggatattccttaccaaattgaggaagttctcctctattcctagtttactgagagtttttattgaatgggtgttagattttgtcaaatgctttctgtgcatctattgatatggtcatgtgatttttcttctttagcctgttgatgtgatggattacgttaactggtgttcaaatgttgaatgagtcttacacacttgggatgagtcctacttggttatggtctgtttttctttttatacattgttggattcattttgctaatattttattgaggatttttgcatctatgtttatgagagatactggtttatagttttcttataatgtctttggttttagtattaaggtaatgctggcctcatagaatgagttagaaagtatttactccactcctgtcctctgaaaaagactatagagaattggtaaaatatcttccttaaacatttggtggagttcaccagtgaagccatctgggcctatgattttggttttagaaggccattgactcaagttcttcaatagatatagacctattcagaatttctgttttttttcttgtgtgagttttggctcattgtgtcttttaaggaattgtttttcaagaaattttcaccaaggttaccagatttgtggacatagagttggtcatagtattcctttattatccttttatttgtccacggcatccgtagtgttgtccttttcatttctgatattagccatttgtgtcttttctcttttgttcttagttagcttgactagaagcttatcagttttcttttcaaagaaccagcttttggttctattgattattttccccattgctttcttgttttaatttcattgatttctgctctaatttttattatctcttttcttttgcttatttttgctcttctctttctggtgtcctaagatagaagcttagattgtttattttaaattgttctttttttctaatgtgttcagtgctataaattttctttttttattctttcttttctttccattttttcttttttgagacagggtcttgctctgttacccaggctggactgcagtggcatgaacatagcccactgcaacctcgactccctgggctcaagtgatccttctgcctcagcctcccatgtagctgggactacaggcacatgccacaacacccagctaatttcacttttattttttatagagattggggtctcactatgttgcccaggctggtctcgtattcttggactccagtgatcctcttgccttggcctcccaaagtgctgggattacaggtgtgagccaccgctcctggcctataaattttcttctatgcactgcttttggtgcggttccacaaattttgataaggtgtgcttcctgtttttacttagttccaaatattttaaatttctctttatttcttttttgacccatatgttttttaagaatgtgttgtttagtctccatgtatttggggattttccagttacctttttgttatgattcctagtttaattccattgtggtatgagatcaaatattgtatgatttttattatattaaatttgtcaacatgtgttttatggcccaaaatgtggtctttcttggtgaatgttccatgttagcttgagatgaatgtgtattcagctgttggttgaagtatctatagatataaatgatgtctagttgattgatggtgttgttgagttcagctgtgtccttactgattttctgcctgctggatctgtctgtttcagatggaggaattttgatatctctaactatagtagtatgttcatctgtttctctttgtagttctatcagcttttgcctcatgtagtttgacattctcttgttaaatgcatacatgttaaggatattatgtcttcttggacataagacataatatcctttatcattttatcattatccctttatcattatataatatccttctttatccctgacaaatttacttgatctgaagtctgctctgtctcaaattaatatagctactctaacttcctttagaaattaatatagctgcttcagctttctttaatgttaacatgatgtatcttcctccatatatatatatatattttagatagagtctcactctgtcacccaggctggagtgcagtggtacaatctcagctcactgcaacctctgcctcccagattcaagtgattcttgtgcctcagcctcccgagtagctgggattacaagtgtgtgccaccacgcctggctaatttttgtattctttttaaattaaagatggggtttcaccatgttggccaggctggtcttgaactcctggcctcaagtgatccatctgcctcggcctcccaaagcgctgggattgcaagtgtgagccacctcacctagcccctccatatatttttaatatgtagttatttttatatttaaggtgagtttcttgtagacaacatacagttaggtcttattttttgatccactctgataatctgtcttttaactggtgcatttagatcatcagcattcaaagtgattattgatagagttggattaatatttaccattttttacttttttctatttgttgttcttgttcattgttcctacatgtgtcttccactgtttttctgtcttatgtggttttaactgagtattttatattatttcattttctctctttttttttttttttgttttttgttttttggtttcttggggtgttttttgaggtgggatcttactgtgttgcctaggctggcctcaaactcccgggctgaagtgaccttcccacctcagcctcccaggtagctgggagtacaggtgcatggcactgtgcccagctattttctctcctttcttagcgtatcagttatatttcttgttttactttttctagtggttgtcctggagtttgcaatatacgtttgcaactaatccaagtctactttcaaataacactatattgctttatgagtaatgcacgtattttttaataacaaaataatcctgattactttcttctatcctttgcaccatcactgtcatttatttcacttatacttaagtgtacataagcatatatatatatataaacatacataatcgcatacactgttgctattattattgtgaacaaaatgttatgctagatccactaaaaataagaaaaataaaagtttttcgccttcactggttccttcttcaatgctgcacttttctttatgtagatacaagtttctgacccctgtcattttccttccttctaaagaactttccttaaacatttcaggatagatctgctggctacaaatcctcaatttttgtttgtctgagaatgtctttatttctccttcagttttgaaggattattttgcaaggtacagaattctaggttggagaggtttgttgtttttttttttttttcctctcaaaactttagatattttactccactcttttcttgcttttgtggtttctgagaagtcagatgtaatttttatctttgagcttgtgtggataaggtgtttcttccctctggcttacttcagtattttttttttctttatctttggttttctgtagtttgaatatgatttgtctaggtgtggttttggggacatttatcccgtttggtgttccctaagcttcccagatctgtggttttgtgtctgacattactttggggaaattctcagtcattattgttttaagtatttcttctgtttctttctctctttattttctctctggtattctcattagctgcatgttatatcttttgtagttgtctcaaactttttggatattctgaggtttttttctagtctttttctgtttgcatttccattttggagatttctattaagatgtcctcaagctcagagattcttccctcagctgtgtccagtctaccagtaagctcatcaaacacattcttcatttccatcacagtgtttttgatctctcgtttccttttggttttttcttagaatatgcatctctgtgcttacattgcccatctgttattgcatgctgtctgtgttaaccatagagcccttagcatactaatcagttgcttccaattcccagtctgataattccaacattcctgccatagctatgtctggttctgatgcttgctctgtctcttcatatttgtgggtttttacttttagtatgtcttgcgactttttcttgacagctggctatgatgtattgggtaaaaggaactgctgtaagttaggttttagtaatgtgctggtaagggtctaggggaggagtcctatgattaagtctcagtcttacctccctcccacccctcaggtgggataggaaggctagagtgggctggagttgggtatttcctttctctcatatggaaggctagaggagactggagttgagtctttcccttcccccaggtaggtgaggctttgataaaaccccagcaggttaggctccacttaagtagtttcttctgagggcagaccttgttaagaacagagtgccctggtgcatttcaaaatagttctttctttcttccccttgcctgaagcataaggggaatttactccagtgtttattgtgagaaccaagtggaactcctgggagtaaaactcacaaaagtgtgcccccttcccccatgactcggttcccctgcactttttgactctcagacttgttgacactgagcctccagcaattgatcagttccagttccagttttcctaccctgatactggttccttcagaggtttctgcctccatttcagctcaggaaagttgtgattctttgtatctgcttgtctgtctctaacttgggggacagtggtttgcctgtgacttcatttttcttacagatctaaagagttgatttttcagttggttctactttttccttgtgatggagaggtaacctccaaccttcttatatgctaaactggaaaccagaaacttccctgacctttttatggatgaaaatctttattttcatggttccttctgatctctggatagggaagagagatcagaaaggagcaataagggaggtcatgtgttgctgctgcaggccgagaacagccttgaggagcacagtgtcggatcccagacccttaggtcttccggctaaaagtgcctatcagcttggagaaggagcaccatggagataggtggtcctaagatccctcggggcagattttaagcacagctttttaaagaaatcctgccttaatacgtttatttgttattgttatcagaaagaaggcacacattcagacttttaataaggtgaatggcaggtgaatcaaaactggagttctttgatttaattacctccttctgccaatatttaggctaagattggtgttaactttcctccagatagaggtttccagaatatataaaatatgccttaaaataatgcttattaaagaatccatgagactgggtgcagtggctgatgcctgtaatcccagcactttgggaggccaaagcaggaggaccccttgagcccaggttcaagaccagcctgggtaacatagtgagacccctctctacaaaaaataaaaacaaaaaattagccaggcatagtggtgcacacctgtagtcctagctacttgggaagttgaggtgggaggatcccttgagcccaggagtttgaggttatagtaaactatgattgtgccattgcaatctagcctggatgatagattgagaccctgtctctaaaaaaaaaaaatttgttaattcatactgacactaacaaaaataaactttaaaatggtggaggtgagtggggaaaagtgaaacctctgctttacagaataccaacgaataaatgtaggaagaattttttaatcaacatttaataacgactataataataactgattcagacagcaatgatcaatagattataaaacctttggatgaaagattgttggagaaaaggatattcatatatctcaaagtgtcatgccacaggttatttattaattacaaagggaaaaggtatagtgaagaaatctagtgggtaccctcttcaaccagataatcaaatttggcatccccagttatgtaaaactgatatcacgtcccacctgatgtgatgcactgggaaggacccatcacctacatatacatggaatattcctggtatcgacgaaaagagtcaaactctgtaaaatatttgaagagatttattctgagtcaaatatgagtgaccatggcccgtgacacagccctcaggaggtcctgagaacatgcgcccaaggtggtcagggtacagtttggttttatatattttagggaggcatgagacataaatcaaatacatttaagaaatacattggtttggccgggtgcagtggctcacacctgtaatcccagcactctgggaggccaaggtgggtggatcacgaggtcaggagattgtgaccatcctggctaacacggtgaaaccccgtctctactaaaaaatagaaaaaattagccaggcgtggtggcgggcacctgtagtcccagctactcaggaggctaaggtaggagaatggcgtaaacccgggaggcggagcttgcagtgagccaagatcgtgccactgggcaacagagtgacactccgtctcaaaaaaaaaaaaaagaaaagaaatacattggtttggttcagaaaggtgggacaactccaagcaggggcttccaggctacaggtaaatttaaacattttctggttgacaattggttgagtttatgtgaagacctgggattaatggaaaggaatgttcaggttaagataaaggattgtgggaccaagttttattgtgcagaggaatctctcagcagacttcacagagagagaagaggttgtaaaatgtttcttatcagacctaaaagggtgcctggctcttagttgattatctcgtggatctggaaaggaaggaaaacaaagggtgaaggggatactctatagaatgtggatttttctcacaagagactttgcagggcaatttaaggcgtggcaaggaaatatactccttggggttaaatattttttccttgtctcataatgttgtgccggagtcatattgaaaagcaagtcacaatatacagggtcaaataaaacccatctgatgagaatccatgatatgtagggcatgactccctggaccccttaggtaggaatttgggtaagataaaaaaatcagagtttagtcctcactggcaatgatgtttggaggaaatagcaaagtccaaattgaaagacattatgcaaaacagcataagtgccccctccacccacactctattcctgtacgaaaggatacttgatacttcaaaaatgtccatgtcataaaagacaaaaaaggaaagagacaaaaagaaacattgttgggagaattagggagatttaggaactgtatatgttatataataataatatatttattgagtgtaataattgtattctagttatataggaggatgttttgttcttagaagatagaatcttaaatctttagtgatgaagtgtcatgatgtctgcaactaattctcagatggttcaggaaaaaatgtctgtgtctgtggaggaggaagaagaagggaaatatggtaaaatattaacaattgattatctaggtaaacagtatataataattggtcgttgtacttttcttgtgacttttaggaagatttaaaatttttcaaaagaaagtggaagacagattttaattacaataaaatttaaaaatgaaataacatttattctgtcttattgctttaggtgaaatccttaaccctgtttgtcacccattatccgccagtttgtgaactagaaaaaaattactcacaccaggtggggaattaccacatgggattcttggtcagtgaggatgaaagcaaactggatccaggtatgaaatattcctgcagttggtacaaatattggttttcatgtttgataactcaaagtttgttggaacatgaacttactgcttattaataatgaaagctgtgaatgtgagctataaataacatttgtcaggattcatttttgctaagctttaggtcaagtagaatttagatttatccttgctatctctgagtccttctctggtcttccttgtctcatttgtcgtggcaacccttttctctttttttacaggaatagggtgtgggtggagggggcacttaggttttcctcttagtgccttgtactcttacatgattcatctcagtacagatgacagtcacctgcagagtataattagtcatcttttaaaaacgcccaatattttccccaaaatatcatttaacttactaagggccatatactgtactggacataggtttttattttaatattataaggaaactgaatctcagacaggtaaagtggtttgaccatgtcaaccacttagatgggggctaaaatgagcctagaattcacttcttctgcttctgggttctcttctgttcccctctgctagagctgctatggaggaaatctacaatatttttcctagtctttccagttactggtgtcacagaaatgagacattttatgaaaaagaacaccgttagccaatagcaatacatttaagtgccataagtaatacagtagactttagcatttttttttctgttcagtagtaattgttttaagccaccagcctgtagtcctgtggtggtttgcgcaattggtatgctgcaatggaaaatccatcatgcaagataccccagagtccagattttattttggaaaagtaatagggatggacctgaaaaagaaatcaggcagctggcccaaataaaacaaagcactgggcctaagataaatgtaatgttaggcagttcctgcttttcaccaccatgcaatcttgaaaaacacatcataaattctcttatggaagtagttttgtatctattaatctgcatccaggttgacaagaggagacttaagctaaaacccttgggacaaagagaatagagttcaccaacagggaagaagaggagtcagtgccgctaatacgcatttgatgtgaactgaaaactaacccagagcattgtacctttcccttaaatgttctgtgcattttattttattgattttaatttttgtgttttgttgagatggggtgtcactgtcatccaggctggagtgcagtggcacgatcatagctcactgcagacacaacctcccaggcccaggtgatcctcccatgtcagcctccccggtagctgggactacaggtgcacaccaccatgcctggctgatttttgtatgttctgtagagacaggctctcactatgttgcccaggctggtctcaaactgttgaattcaagtgatcctcctgccttggcctcccaaagtgctgggattacagggatgagctaccttgcctagctgattttaatttttatcaatgaacataatttttaaaattcaatggtgctaaaaggctcctgctgacaagcttccatcccttcagttcacgtccttccccatcctagtcccaaggcaactactttcaacacttcccctttctgttgtatttctaagtaatatccgtattttcatgtctcttgcttcatcaagttgacacattattgatggacctctcattgtgttaattgagaatcttcaattttcccttcctctgtccttccagtatagtcatttcacatgtattgtatgtcattcatacttgttgttttcattattattgccatgctaaatattgcttactgatgagccaagtttggagacaagtacatttctttcttttacaacgttttctattttctcaaaaataagaattgactgtcctcattttttccattttgttttgttttgtttttgagtctatagctgaatcttcctgtaccctcagatagcttcgtaaaatgcctctctagatgtttttccacacaactgaacctactggttcccatttgtccactggggcccttcctcctggagccctttgtcctcctgctcatctgaactggctgctgtctgggcctgcggcacagctgtcatcctaagcctgccttgctggcatcctaggagttcccttacccctcttctaagcatgtgattgcaaggaacaaaacactcggtctcacactggctcagacaaaaggatgcagtatatataatcccatgttccatgacttccagaggaagagtgggcttcagctcctcctttttgtaattcccaggctctgtcttcctgcctggccagctttattatcaggctagtgacaatgactgcagctcttcctggcatcatgtccagaatgtccaaaggaagaagagacaagcatttcctgttcactctttcttagaacaagggaactttttctcagatgccttccagtatctcatgattgcctcattgcattttcagaattgagtaacaggctccttcttaaaccactccttagcagaggatggcaggggtgactttgatgggcctagatgaatcaggatcaacttctggagctggctttgaagacccagtcccctgagttaaatgattagggagttaattccttataaaatcaaggttttcttaggggtggaataaatgttgaattaggctactactaatatcaactaaaggaggtaaaagttttgagatttttcatgaatgaaaatgtttcacatgcttgttggccatgtatatgttgtcttttgaaaagtatctgttcatgtcctttgcctattttttaatgggtttggttttttcttataaatgtaagttccttatagatggtggatattagacctttgtcagatgcatagtttgcaaacattttctcccattctgtacgttgcctgtttaccctgttcatagtttcttttgctgtgcaaaagctttatagtttaattaggtcccctgtgtcagtttttgcttctgttgcaattgcttttggcctcttagtcatgaaatctttgcccgttcctatgtacagaatgataaaagcaaaacatcactgaccattagagaaatgcaaatcaaaaccacagtgagataccttctcacaccagtcagaataggtattattaaaaagtcaaaaaataacaggtgctggtgaggttgtggagaaaaaggaatgcttatatgctgggtgagagtgtaaattagttcaactgttgtgtaaggcagtgtggtgattcctcaaagacctgaagacagaattaccattcaacccagcaatcctgttactgggtatatacccagagaaatataaattgttgtgtcataaagacgcatgcacacgtatgttcattgcagcactattcacagtagcaagacatggaatctacctaaatgcttatcaacggtagactggttaaagaaaatgtggtacaaatacactgtggaatactatccagccataaaaaacaataagatcatgtcctttgccggaatatggatgaagctggaggccattttccttagcaaactaatgcaggaacagaaaaccaagtgttgcatgtttcacttataagtgggagttaaatgatgagaacacatggagacatagcggggaacaacatacactggggcctactagatgggggagggtgggaggagggagaggatcaggaagaataactaatggatacaaggcttaatacctgggcgattaaataatcagtacagcaaacctccgtgacacaagtttacctctatagcaaacctgcacatgtacccctgaacttaaaagtttaaaaaaaaaaacaacaactctatagcttccatgttcgaatttatagttcagccaggattagaattttagattgaaaaccatttcactcagaattttgaagcagtgctccactgcctgctgccttccaatattgttcctggctatatctgtgcttcatccattacctcttccccaacttctcctcttctgtatgaggtagaggccattgcgtaggtcatcagtaaaatgccccacaggtcttttggatggcttctataatactctatttcctatgatgtgataggtaaaacaatggacaaacagttaagaaacctgtgttttagtctattccaatctgtatgatcttgaacaagtcacctaacttcactcacccctaaatttttatgaatctgttctaaaagcaacttcagaaattatttgtcagtacacatctctttaataactgcttagagaagtttggcttaaatataaatcttgctatgtttccccataataagcagaaacatgaattattacttccactgactcaaagcagtgccaggtaaacattttaataatgtccatttaagaaatggccatagcttgtaagtagttacatcctcatcaagaacttttgctgtgagcctgtaaagaaatagagtttttctcataaaacaagttttattctctcccatgtggctttttctgactccatatttccatcctaccagcacccccaacccctctcgcacacagaggttaaaggagtacataattacagaaagagatcccccaggcgattatagaagagtggttgcgttctttaccttgaagatatgagaactaccataatttaaagtggagaccagcatataatgatacactcagcaactgtttgtatgttaacaaggtattcagagcagtgaaatattttatgtaagttagctatattttgtagctatattatacattatatatataattatataagaacattgttacaactatctcttgtgcactctttatatatgtatacatatatacatatatatacatatatacatatatatatacatatatacatatatatacacacacacacacacacacactatataaaaaaattaaaagtcattaataggctgggcatggtggctcacgcctgtaatctcagcactttgggaggccaaagtgggcagatcacctgaggtcgggagttcaagaccagcctgaccaacatggagaaaccctgtctctactaaaaatacaaaaagtagccgggcatggtggtgcatacctgtaatcccagctactcaggaggctgaggcaggagaatcacttaaacccgggaggtggaggttgtggtaagtcgagatcatgccattgtactccagcttgggcaacaagagcgaaactccgtctcaaaaaaaaaaaaaaaaaaaattcattaacaaatttttggatagggggattttgtggcatttatcaggctcccagaaaatactgatggctggatggatggatagatggacagacagacagatgaatgaatcttgtttagaaaggtcagcatgggatctagattatattggagagctggagacagggagatcagttaggactaacacagttgaagtgataaactatttttctgtcttaaagttaagaaatggctttttttgattgcctattgcctttcacttcactcttagtcttgtgaactttgaagagttacaaaaaattatccaggtttgcaggcactggcttctagctgcatcttccctaatctgttcccacctacttccgcacctgtgtttctcaactttcatttgggggcaaaaggtactgtcagtgccttgcaacggaagtttaggtctgtgtttctgagtgagttggcattctttccacctcccacttcagcacccacccttggaaagctcttatctgtctgctgccgaattcttagaggagggccaggaaaaatccattgtcctttttctctgtcatgttcagtctttggctttttaaattttcactgataaaagaagaaaagcatacacatctatcaaatgaaataatgattgagaaaaagcttttaataaactcataagtatactgggattgtagaaatctttgtaactcttgtccaccttggacatttctgcagcacagtgcacattttgcagcacaattatattgaatttcataataaaagttacataatatcctgagctgctttagcttaaactacatgcagtggtttatgataattattgtacttcattatatcccagttcttttaaagttttaagttcatgtgtatgtatatatatgacaggctgggtcctctaggaggcagattctgagatttgcattcaggaggttcattcggagtgctgggctgtgttatggtcaaaaggcttcagccagccctgcagagaactctgaggctagagtggtccttcagagttacctcaacttggggtgagggggatagacctctatacctttattagttatctctattagtttggggtaatttgcaaacagtgtgcaacagattaccccccaaaacatagcggcttagaacaacaaacatttattacctcataatttctgtgagtcaggagtccaggtgcaacttagctgaacacctctaaggctgaaaactgtagccctgtaagagaccctctagttcggttcctcacagggctacagtcagtcactaatcagggcagcagccatgtcaaggcttcccagcccacacatggctcttgccaagcctcccaatatctgcttccaagcccactcatgtggctgttggcatgccttaggctctcaccaactgttggtgggagacatcagtttctttccatgtgagcatctccacagacagcccacaacatggcggctggcttccctcagagcaggcaggcaacaaaatgagagtacccaagtcagaagccacaacctttctgtaacctaatctctgaagtgacatctcatcacttttgccgtattctgtttgttagaagtgagtcactggttaggaatgatacagagagggaatgacacaagcacgtgaacaccagcaggcagaggtctttggtggccatcttagaggctgcctacaacaaccagtcactggctgtaggctgccccaaagcgggatgtggtcttgggtgaagcccctcccttcagctgcaacaatttccaaagaaggcaaacagtcgagggttgcaggccagcaatctttctgacagctgagggaataaactctttagtcctaagtgggatctgggtggtactgaacagaatccggtatgtatagctcttagttaacctgaatatttaataaaccagaccatcttaatcctgttatttaaactggccaacatgtaatattttcttttctgtttttaagggagaaattataggcctggtatggtggttcatgcctgtaatcccagcactttgggaggccaaggtgggtggaccacttgtgcccagaagttcgagagcagcctgggcaacatggccaaaaccccatctctacaaaaaaaaaattagctaggtgtggtagtatgcacctgtagtttcagctactcgggaggctgagatgggataatcaccttgaacctggaagattgagactgccagtgagctgagattgcgccactgcactccagcatggatgacagagtcagaccctgtctcagaaacataaaaaggagaaattatattgtatcaaccacgtactaagatcattctcatcctggcgcagtggctcacgcctgtaatcccaacactttgagaggccaaggagggaggattgtttaaagccaggagttcgagaccagcctgagcaacatagcaagacctgatctctacaaaaaatattaaaaaattagctgagtgtggtggcatgaacctgtagtcctagctacttaggaggctaggcaggaggattgcttgagcccaggagtttgatgttacagtaaggtatgattgtgccactgcactccagcctaggtaatagaacaagaccctatctctaaaaaagtaaataaataaaaacattctctttttaatatagacgttcagttcaaatttgcaatgaatcattgttaaaaactattttaagtgaactaaaagatagatcctatatgcacacagcagtttcaaaacagtatttacccttttctagacatatcaaattgataaatggatctaacaggcaagtaggaacagtgatttcagattgtacgatttaataaagttatgagaacttacatgtcctttttaatcctctaatttatttcagctttcaggcacagttttgatctcctttctttatttcacaggcgcagcagaacaagtccctgattttgtcaccttcctttaccaaataactagaggaattgcagcaaggagttatggattaaatgtggctaaactagcagatgttcctggagaaattttgaagaaagcagctcacaagtcaaaagagctggaaggattaataaatacgaaaaggtcagagtgattatgctgcattttttcatttgtaatgaaaccttctaagttgtccaagaaagagaggagcgtcctaaaaatgaacatcaggtctacttttaagcacctcttcaaatattctgaaccatttaattatgatgaagtgaaaacagctcttgcaaagctcaggtgaattcagtccatcttcattagatcattattaagttgctaaattggtttttcggtcatttttataaagaattaagttaactccttaatatgtgccacattcattactttaaagattcagtatgccaaaggttactgaagatattgagaacctacagaagatttcttttattcatagattttattcagatatgcaacgattacatccagaaattctatcagagcattaatgaaaataatagtattacataacaggcaatcacagtcagtatccacatgtcacttattttgtagattgtgacaaatttttcattctaaacaggctgctgtcactttaaatgcttatgggaatactttccacctttacgcttgctatccagctagtatgtagtcagtacataaattaatcttaatgtaaacctgagatacactttgaaagaaagatattcctagaaaaatatcatattagtaaattatacccttttgtttcccaaatataaaattctaaaacaacataagctccccatccacctactgccccacccctgccgtacttggggagcctggtgtgctgggtacattagtaccctggttgataatcatatgaccatgatgaacagattgttgatcgaatagaaaatcttggctggctactggtggtccctgtgttatactccaataatattctttaatatttggttataattctgggaattattaccaaatttcaatattgaaatagtaatgcctatcatactagctaaagaaacagttgctaacttgtttaccaaagtacagtagtgcagttaacttctctttctctacctccttctcctgtgcttccgccttgcactcctccacttcggtatactgtagttcaccaagtccagagtgctggactctacaaatggcacacagcctcctctagtgacactcttttctggctcatttccaaattgcaatgccaaaacagaagcaaagtggcataatcagtttcagcctatttctgttacaagccagattaatataaaatttttcctgagggaaaagtatctatgagaatttaaaaataaacttagccctcttcctctgcaaagtccagagacaaattaaactctttagttgccatattattattgttctttttctctgaaaaaaacctagaataaaactttactacaaaggatatatatacaagatagtaataaaatatgtcaatttctaaatttgctgtagaaatatatgcaagatagcaataaaatatggcaatttctatattttcatatattcttgtttctgctatatagcctataaagcaagagcaaaaaaactctcagattactcataaatattttaactcttccaactagtaagtgacattttgaactctatgaagttatcttgacaagatgagagaattattagaagacattgcattgggatggaatctgatcatttatcaagatactgtatttgttattttaccttttttctaaaagtgcttatcacatcaattcctttggccagatcaaagaaatcaaactgcatcttgggccttactgtggatttgttataatagttgctatttgttggatggttactgtgtgtagaaaccattctgagcagtcatttgcagcagcctacacactgtgccagctactcttctcatcactttacatacattatctcatttcatccttatggcagccttatcctcatggtatagttggggaaagtgagaccagcaaggacaggacactgacccagagtcacacagctacttgatggtggagcagtaattggaactcaggtactctagctccataccctaaatagtcaattgggttgctattctgcagaaaaaaaaaaaaagtaagtctgtgttatgctggcgttttactctttaattagcttcattgttttcggttggtgttacttttcatcctgggaacacttcataggagtttcttttctccaggtacaaataagcacacaccaccagcctctagcagagtttgaaggaggaggaggtcaggttctcccctctggggctggcaggggtaaggattttaggagaaggcacaaaggtaatagtggcaattggtaacctgggtcccttgattatagtagcagctctgaaagctcctttcactggaagggtgacactgacacagcttcctaactatagagcctgcccggtattcaagtgttatagacttttcatagcttctgatgagacgtattgtctcccagcaatttcatttattaaataagtagtatttgatttttccccagaaagagactcaagtattttgcaaagttatggacgatgcataatgcacaagacctgcagaagtggacagaggagttcaacatggaagaaacacagacttctcttcttcattaaaatgaagactacatttgtgaacaaaaaatggagaattaaaaataccaactgtacaaaataactctccagtaacagcctatctttgtgtgacatgtgagcataaaattatgaccatggtatattcctattggaaacagagaggtttttctgaagacagtctttttcaagtttctgtcttcctaacttttctacgtataaacactcttgaatagacttccactttgtaattagaaaattttatggacagtaagtccagtaaagccttaagtggcagaatataattcccaagcttttggagggtgatataaaaatttacttgatatttttatttgtttcagttcagataattggcaactgggtgaatctggcaggaatctatccattgaactaaaataattttattatgcaaccagtttatccaccaagaacataagaattttttataagtagaaagaattggccaggcatggtggctcatgcctgtaatcccagcactttgggaggccaaggtaggcagatcacctgaggtcaggagttcaagaccagcctggccaacatggcaaaaccccatctttactaaaaatataaagtacatctctactaaaaatacgaaaaaattagctgggcatggtggcgcacacctgtagtcccagctactccggaggctgaggcaggagaatctcttgaacctgggaggcggaggttgcaatgagccgagatcacgtcactgcactccagcttgggcaacagagcaagactccatctcaaaaaaaaaaaaagaaaaaagaaaagaaatagaattatcaagcttttaaaaactagagcacagaaggaataaggtcatgaaatttaaaaggttaaatattgtcataggattaagcagtttaaagattgttggatgaaattatttgtcattcattcaagtaataaatatttaatgaatacttgctatagatgatggtatgtcccattgaattttggtgtttccaagtgtttggaaattgtcattttttaaggtgtaattatgaaattaaggttactgctttgaccagcgcaatacacagaagtgaacttgttcatttgggacctttctgttcattaacatatcaggtgtatcatcttcccagtaatgagccttatagcttagttgattcataacagtgctcccttcctgcaaatttagggtaacacgtgctcaactgtgtccctgggttttttacagcacttacaatctggcttcccagatccatgtgttctttttgtttctaaatatatgatcttgcacaaaagctctccatcctattttcctctcttttattatttctgctcagttaaatgtcttccccacatttgatggacatatttttaattccttcttctggattattatcttcagtgatcccagcaatgaccccagccagacacaggagtcaatacagtgtccccaagttgtggcttcacttttgagtcagtcactctttagctatctgactctcaaccttattggagttagagtgtgatgtaatttgattgattctaccacccctccagaaatatgaacgtatagtcagattctcaaaactgtcaaaatagttagttggaatgtacgctttaaattttaaaaagaacaaaattgttccaatactctatataactgtaaatgtcttatattttttctaacaagatttcaaagatagtgctgtaacctcacctcacagggagaaaaggagataactccaggaatttcatgcccatgccagagggagctgcagggaccagcaatcactggtaatgtccaggtggacatctggagccacctctccctcttgcttggtccaggccagcatcaacactgaagcaggtaggggttccaggagcattgtgtcctggcagtggcagcacacagtgtctggcagctgacaacgtggaactttacagggtagattgtccagcatgatcaggaagccagccaggcggccagcttgagggaaggcaggcctcctccaagctggggaagagatcagcacagctgaactgcatttccaagtgagactcatccccagctgggttactgagatattggaggaaacgttgaggccaaatcccagtcataaagactgcacaaatgccatggggaggtaggcagaaagttgcaaacaagtgggtttgtatttcagataaccatcttggggctgcaattctaaagttagatataatcacacaggtgagaatagggctgctggtgcatggcaagcgccctccacattccctctggtactgcataggcatgagcctgcaggctaaatgtcttccatacttcagacagaggctaggggagacagggctgactggtggccaaatgtcaaggaaagtaactttttaatacgatatattcctttaagtgacttgtccgtttttagccatcaaattacaaattaagagctagtgattctgcagtaacacacaccaattcctcgaaaaccttctaaagtcacaccagtttaataattccaaccttagggaaacaaagccaaacatattttaacaagtttgaactttgacctttctattgcttcatctctcctcagtgctgtttattctatatagtttttaaaatagtgttattatataactagtataaaatatttgaaaatccatgggactatataatttaaaaagagaaaaaaggaaaaatgaatttttaaaattaaattttgtaaggtaaaaataaatttaaaggctgggcgtggttgctcacacctgtaatcctagcactttgggaggccgaggtgggcagattgcctgagctcaggagttcaagaccagcctgggcaactcggtgaaaccccgtctctactaaaatacaaaaaattagccaggtgtggtggcatgcgcctgtagtcccagctactcgggaggctgagacagaagaattgcttgaacccaggaggtg

SEQ ID NO: 37 - DNA, 30807 bp, Homo sapiens
cactatgttgctagctggtcttgaactcctggcctcaagtcatccttctgtcttggcctcccaaagtgttgggattgtaagtgtgagccactgtccctggccagttggtgatttatttgtataactgtccaatttattgaatacgtatggcgtgccaagcactgggctgagggcttcataatgccctttcactcaatgcttagcacaacccatgaagaaggtagtgttaatatcatccctgttttacagatgtagaaactgaggcacaggctaaataacttgcccaacaagctcgtgcagtttagtaagcagctcagctgggatgtgaacacaaactttgaatacagagctcttaaccagtaggccagaggttcccaaacacctagtatatttactaccttagtactttcctgccacatctcctaggccaaaacaactccattgattgttatgcaatttactaagtgtagccatttgaaaaaaaaatacatataaaagaaaaatatttttattcagttttcaaaataacccatatatagtcatggaatgtatgtgttggttgggcactgcagactaaagacagtttagggccgggcacggtggctcaggcctgtaatcctagcactttgggaggccaagtagagagaagggcttgagcccaagagttggagaccggcctgggcaacatagcaagacccagtctctacagaaaataaaattatcagggtgtgaggacgcacacctgcagtcttagctgcttgggaggctgaggctggaggatcagcctgggcaacagagtgagaccctgtctcagaaaaaaaaaaaaaaaaagacagacttttattcagatatgcatgcaggagttcacagaaaaaaaaagtgagtccaggaggctgttatttggcatttatacaactttttttttcttgaatctcgaaatctactttatatataccatttaataggggaagaggagggagaaaaagccttccatgggaagaacaaataggtttctgggggaacaaaagggagataagaatgtttgtttttgcaggtgcaagtggtctttgtctttttttctggccactaaaactcccctagagaggagatttacggcagcttcactcccagaaatttctgctgttagtcgcataagggaagctttgaaacggcatctttctgcatctgttggctctcaaatgtcttcagttccaagtaacattcatgccaattctgggggtctgagtgtccccacataatacatgtgttctcttgtcttttaatgaagtttgtgggaggcatctaactgtagcctccaaaatttggcccataggtactactgtccttatcaaagacgaggaaacaagttcagaaaagtattaattgctccgagttatctgcttggctagctaggatcagagctcagttctccatttaacccaaagcccaggctcttaacctcttacaactggcgcatcccctctgaacctccatttcctccctgtaaaagaataacatcggccgggcgcagtggctcacatctataatcccagcactttgggaggcagagatgggcggatcacgaggtcaggagtttgagaccagcctggccaacatggtgaaaccccatctctactaaaaatacaaaacttagctgggtgtgttggtgcctgtaaccccagctactcaggagactgaggcaggagaattgccttaacctgggaggcggaggttgtggtgagccaagatcgtgccattgcactccagcctcggtgacagagcaagactccatccccaaaaaaacaaacaacaacaacaaaaagagaataacgttatattcagttgaaccaaaatgaattaaatattaatatttgtacttcaaaaacggtccagcttggctgggcgcagtggctcccgcctgtaatcccaacattttgggaggccgaggcaggaggatcatttgaggtcaggagtttgagaccagcctggccaacatggtgaaatcctgtctctactaaaaatacaaaaattagctgggcagtagtagcgcgtgccggtaatcccagctattcaggaggctgaggaaggagaattgcttgagcttgggaggtgaaagttgtggtgagctgagactgcactactgcacaccagtctgggagacagagtaagaccctgtctcaaaacaaaacaaccaaaaaaccaaaaaggtccagcttgggcaacatagtgaaacttcgtctctacagaaaatttttaaaatactagcagggcaccgggcacagtggctcatacctgtaatcccagcactttgggaggctgaggcaggcgggtcacttgtggtcaggagtttgggatcaggcaggccaacatggtgaaaccgtgtctctactaaaaaacaaaaattagctgggcatggtggtaggcaccagtaatcctagcactcaggaggctgaggcatgagaattgcctgaacccgcaaagcaggggttgcagtgaaccaagatggcgtcactgtactccagcctgggtgacagaataagactcctcaattaaaaaaaaaaaaaattagctgggcatggtgttgcgggcctgtggtcccaggtactcaggaggctgaggtgagaggattacttaagcctgggaggttgaggctacagtaagccaagatcacgccactatactccagcctctgtgacagagccagaccctgtctcaaaaaaattttaaaaagggcaaattttggcaatttcacatagttcaacctagtataaggtggttgtaataactaaatgagataaaatggtgttaaattggaagtattatagtatttctgttaacaacatagggctccagaaccagcttccttgagtttaaatccaggctccaccacttcctagctatgcagtcatgggcaagttacttgacccaactgtgcctcagcttcatccatgatatggagatacaggataaccagcctcttacgtgcaattctgaaatccaaaaagctctgtaaaccaaaagtttgggggtaaactcatttggtagcaaattttgacctgaggctatttatagtctatattctgtattctttctacttagtatgaataagcatgtaagttttactgcatgtttgatttcagcatgttcccccagactctctgggggtgtttacgtatgccggtgggggaaagagaccaactctcaaatattatctcaaacagttggtttcactgtgcttgcttgggtagcacatataccaaaattggaatgacccctgcacagggatgaaatgcaaattcgtgaagcatactgtatttttcttagcacataccacctttggcaatattctttttttttttttgagagggagtcttgctctgtcgcccaggctggagtgcagaggcgcgatctcggctcactgcaagctccgcctcccgggttcacaccattctcctacctcagcctccccagtagctgggactacaggcgtgtgctaccacgccaggctaattttttgtatttttagtagaggcggggtttcactgtgttagccaggatggtctcgatctcctgacctcgtgatccgcccacctccgccccccccccgaagtgccgagtgctgggactacaggcgtgagccactgcgcccggcccccgccttttttttttagattgattttattacttgcctagcaaaggagaaccttctggcagaacagtctccaagaacaaggcaaacaactaattttacataggtttttaccaatgtacagctgttgattgtgactggtttccggcaatctggatttcacaatctggataaggggacaaacaattgtctgtcttccactatctttcttgaatttgaatagaacctttttattctcatagcctcttagctttctttcttttttttttgagacggagtttcgctcttgtcgcccaggctggagtgcagtggcgcgaccttggctcactgcaaacgctgcctcccaggttcaagttattctcctgcctcagcctcccaagtagctgggattacaggcgcatgccaccacgcccggctaatttttggatttttagtagagacgggggtttcaccatgttgactaggctggtcttcaacgcctgacctcaggtgatccgcccgcctcggcatcccaaagtgctgggattacaggcgtgagccactgcgcccggcctctcatagtctcttagctttctaaaatttgaaaaatcctgtaaagacacacctgggtcaaagggctcagataacggactgtggcccttaagtacttacgtcacaggttattgagaggatcgatttagttaccagatgtaaaatgctgggatcagtgcctggcaaaggaaaactttgtacagctgcaggctttcaccatacacaacagcatcgctaacgaatgctattacaatattcatttagcgtttaccaagtgcctactctatacaaatcttgagaatacaacgtgaaggtgaactgctgactaaagtttggtccctttcgctccgtctccttgcgaaaatgctctaacggcaggaggtcacgcgagcgctggacgcgtttctccccgcgagcccctttccgaggcctttcgggtccccccggttatccccgcccgggcggtgcgcgcccccgctgttcccgcttccgctccagagaggcagggctttccgagcctgctagccccgcggccgcaactaaccccgggtcggagtgttccggcccggccagccccgcggcgtgagggaaggggagctcagcagttccccgcgcggggcccaggcgtcggcggcagggcgggcccctcaccgccagcgtgccagccccgcccctacccaccagtgtgccagccccgcccttccccacgtcgccgcgcgcccgggggcggggcctggcgcgcaccgcccgcgcacggcgaggcgcctgttgattggccactggggcccgggttcctccggcggagcgcgcctccccccagatttcccgccagcaggagccgcgcggtagatgcggtgcttttaggagctccgtccgacagaacggttgggccttgccggctgtcggtatgtcgcgacagagcaccctgtacagcttcttccccaagtctccggcgctgagtgatgccaacaaggcctcggccagggcctcacgcgaaggcggccgtgccgccgctgcccccggggcctctccttccccaggcggggatgcggcctggagcgaggctgggcctgggcccaggcccttggcgcgctccgcgtcaccgcccaaggcgaagaacctcaacggagggctgcggagatcggtagcgcctgctgcccccaccaggtagcggggtgggggtggggtcgaaggcgggggcatagcggcggggcgcttggaacccggcgaggggaggctcgcacagggggttgggggggtgcacggcctggccctgggctcggaggaggcggggccgcagagttggcttgaatgagtgcaggggtcgagtctggagcatttgggggtgtagcttgtaaacagggtcggaggagagaggctgtgcaggaagagggctgcaggggagacgcggagagttcgggccttttggagggaggagacgcgtcccgccaggtgggggtgctgggctaaggaaggggcgacgcgcgcagctccgggtggggagggggcctgggaggtgggagcactgggggtggggcgagaaggggaaggcgcccggcccacttggtgggcggggcggggggcggggtggcgggaaggaggaatgcctgcgggaggccgaacggggagagtccggtggtgtggggtgcgaaaggaggttcctcggccggcgcggagatagtgagttggggctccagtagtcgatcgaggtagacacttagaggtagttaagagccgcggtcgccgagacgccttggggacggtgggccttcggcctaggtgaggggccgccgagggggtgggccacgagctgcgagcgcgggggggtgtgtcaccatggggaccgcggggcctaattgggcggggcggggccgtggggagccgaagtgctgggatccggctgggtccttcggtaggtaggctgcacgtgcaccgagacgaagatagaatattttgacgtatgtggaaattcgtgtcgagtggaaaatattttattttatgaaatagtgtaatttttatggggcaccactgggcttttagaggccttaatcgggcgctggacaaagatgtgtggacgtgagtgactccggggaagcctgtcgggagttgtcctcactttatgggcagttaagtgcttttttttttttttcctttttgagagagagtttcgctcaagtccaggctggagtgcaatggcgcgatctcagctcaccgcaatctccgcgtcccggcttcaagcgattccccagcttcagcctcccgagtagtcgggattacaggaatgcgcccccacaccccgccaattttgtatttttagtagagacggggtttctccatgttggtcaggctagtctcggaattcccgacctcaggtgatccacccgcctcggcctcaaagtgctgggattacaggcgctagccaccgcgcccggtctgtttagggctttttatccgggcagctggcgacattttgaaaagcttgcttttgctgtttgccagatacatatatatgtattttgagacagagtcttgctcttttgtccaggctagagtgcagtggcgcgttcttggctcaccacaacctctgtctctggatcaagagattatcctgcctcagcctcccaagtagctgggactacaggtgcgccccaccacgcctggctaatttttgtatttttagtagagacgggtttcactatgttggccaggctggtatcgaactcctgacctcttgatcggcccgcattggcctaccaaagtgctgggattacaggcatgaaccaccgagcccggccgtttgtcagatactaaacacaaagtttaatggtcgctatttgaacaaacgaagaaataaaggctcagaaaaaataactcattcaagataagagccagttcgtgttttttgtttggttttgttttgaaatggagtctcgctctgtcgcccaggctggagtgctgtggcgctttctcggctcactgcaacctctgcccgccgggttcaagtgattctcctgcctcagcttcccgagtagctgggattacgggtgtgcccaccgcggtccggctgatttttcaccatggagtttcaccatgttggccaggctggtcttgaaactgctgacctcaagtggtccacccacttcagcctcccaaagtgctgggattacaggtgtgagccaccgtgcccggccgctagttagtggttttgagtaatggatttcaaatccatttaaatccagtttaaagtgtcctaaaggaattctgagatttttctaagtgtaattatagtgttacccttgtttaagcgaccctttcccgcagtttaaatatatatagttgtgcattagtagaatatgcttgtggggaacagagccagcatccgcaataacaaactcctggttagaaaagcatgacgtattgtttacttgagcatgaattgattgttgaatccaaaccaaacgggtgtatttattgtaaggatgtactttacattcatattgaatagcgtatgttatttgtttcttgaggttgagtttaagagacttgtaaaaataaaacgtatacatttcacctcccgttatggagaggattccagggtattcaagaaagatgggcatttgatactaggtttctaaagaaactgcagtgtctagatcactctgccgagcacagcattaggcattatggatcctggatacaaccatgaacaggacaaagcaaagaggcaattgtagactccaagtggaaaggggacggagaggatgcgggtcaggctaggctctcagctctgtaaaccgaaaccagaaggacaaataagcttagacagattatagtgagagtgggaagctggttcaggaagaggaaggtctgcaaattgtgggtaggatgaaaggaggaggagggagcattggagaagttaagcagagatccaatcatgaacagtctgatgagctacagagacattcggacttactccatgaatcatttaagccttaaaacatgttgagcgtattttttttttttttgagacggaatttcactcttgttgcccaagctggagtgcagtggtgtggtctcagctcactgcaacctccgcctcctgggttccagcgattctcctgcctcatcctctcaagtacctggtattacaggtgcctgccaccacgcccagctaatttttgtgtttatagtagagacgggtttcaccatgttggtcaggccagtcgtgaactcctgacctcaggtgatccacccacctcagcctcccaaagtgttgggattacaggcgtgaaccaccgcacctggccgtgagccaccgtgtctgtccgagcatcttttaatgtttgtcatttagatttcttcttgtgctgaagtgtttgtcttttgctgtttcttttttttttcctagttctttgtcatttgtgtgtgatataaatgtcttctttcacaatgagttctttcatttagtttatggctttgttgttgttgttgaataatagaggtctcactttgttgcccaggctggtgttgaactcttgctctcaagcgatcctcccacttcagcctcccaacctgttgggattacaagtgtgagccaccacacccagccttatggcatctttcgatgaacaaattattgattataatgtggaatttgtccttttattttctctgtggttagtgtttctataggttttatttaagaaatccacagggaggctgggtgcagtggctcatgcctgtaaacccaacactttgggaggccaaggcaggccaacatggctagaccctgtctctccaaaaaataagaaaattagccaggcatggtggcgtgtgcctgtagtcccagcttcttgggagactgagatgggaggatcgcttgagtccaggaggttgaggctgcagtaagccaagagatcatgccatgcactccagcctgggtggcagagtcagaccctgtctgccaaaaaataaaataaaagttggtgaaaatgttgattatatattttaggaacaactagtaattgacatcaaaattatgggctaaagagaaagcaaaaataatgtgattttaaaccagaattcaaaagatctgtttagcgtatgtttagacaaagccattacttattatatcaaagttttaacatttattttgtgagctgtcagcttttcctcttaacatttttccccaccgtcttaaaaaaccccaagaataccggacatttaagactcacttaaagctttaaaagcacttgcaaaatcctaaaatcataatttaaggtgtttttggagggcaggagcaatggtggcaggcagtgttttgctttgttgcccaggctgaagtacagtggcagatctcggttcactgcaccctcgacctattcggctcaagtgatcctcccacctcagctttctgagtagctgggaccccaagtgcacaccaccccatgcctggctaatttttaaatttttttgtagaaacaaggtctcactgtgtagcccagatggtctcgaattcctgggctcttaagagatcctcccaaagtgctgggatcataggtgtgagccaccacacctggcctattttggcattcttgaaaaccgcaggattaccacggataaaattttaaaattacctttaaagaattcaggtttacacacaaaaaaaatttggtttgttagcagtgagtgaagaaaaattttgagaaatgtttaaaatttttagttttgttacacaatacattttactacctgtttaattatcttttttgactcagaaaccagtttcctgggtccaggatgtttagtggtactctttttcttcaagctttttagcattggaggaactgcatattagtaaaatttttagtcttagcattttatagcttactgctatttcttttctttcattctttctttcttttttttttttttttttttttttttgagatggagtctcgccctgtcacccaggctggagtgcagtggcacgatctcggcttactgcaacctctgccttccaggttcaaatgattctcctgcttcagcctcccgagtagctgggattacagatgcccgccaccatgcccagctaatttttatttttttagtagagatggggtttcaccatgttggccaggccagtctcgaactcctgacctcgtgatcaacccgccttggcctttcaaagtgctgggattacaggcgtgagccaccgtgcccagcctttttctttttctttttctttttttttttttttttgagacggagtcttgctctgttacccaggctggagtgtagtggcatgatctgggctcactgcaacctccacctcccgggttcaagggagtctcctgcttcagcctcccgagtagctgggattacaggcgcctgccaccatgcccagctaatttttgtatttttttagtagagatggggtttcgccatgttggccaggctggtcttgaactcctgacctcaggtgatctgcctgcctcgtcctcccaaaatgctgggattataggagtgagccactgcgcccggcccagcatactgctatttctttctttctttcttcttccttttttttttttttgtttttttttttttttttttttttttgtgagacggagtctgtcgtccaggctggaatgcagtggcgttttcttggctcactgcaacctctgctgcccgggttcaagtgattctcctgcttcaggctcccaagtagctgggattataggcctctgccactgcacttggctaatttttgtatttttggtagagacggggtttcaccatcttggccaggctggtcttgaactcctgacctcgtgatccacctgccttggcctcccaaagtgctgggattacagacctgagccaccgcacccggcccatactgctatttcttaacagcagagaaattatgtgtcagattctgtaagtgtaatggtatataaaggataaaatgatgttgaaaaacaaaattttttgtttaaatgcttatgtttctaatattttatttcagaaaggaatttatttcaaaactgataatggttggatccagcttttcacacaaacttttttttcctagtgaggatgcacatttatcctgtaaacaaatggaagacattatttttttaattgcttgcttagaaatgaaataattcttttctaatgatcttttaaagcatgagacctcatacatcatttaaaacaatttatactgtattttacacatgacaaagttctaaggtaacagcccttttctaagactaaagttacagtcctccctttgtatctgagggggattggttgcaggacccccctgtgaatacccaaatccttggatgtccaagtcccttatgagatgtagtatttgcatataacctatacacatcttcccctgtactttatctctagattacgtacaatacctaatagaatgtaaatgctttgaaattagttgttcagctgtattttaaattttgtattttttttcctttttttttgagacagagtcttgctctgttgcccaggctggagtacagtacagtgatcacagctcactgcacctttaacctcccaggctcaagctgtcctgcctcggcctccccaagtgttgggattacaggtgtgagccatcatacctggtcactgttttttattggttttaaatttttgatttaaaatttttaatctaggttggttgaatctggactggaacccaaggatatgtttgttgagcatactgtatttactttggaatacaactagaatgcttaacttgtatgttaaaaatactttatttggccaggcgcggtggctcacgcctgtaatcccagcactttgagaggccaaggcgggtgaatcatttgaggtcaggagtttaagacgagcctggccaacatggcaaaaccctgactctacaaaaaaaaggtaaaaataagccaggtgtgatggcgtgtgcctgtagtcttggctattcaggaggctgagacacaagaatcgcttgaaccggggaggcacgttacgccctcagttgttgacttgagtttttccgtagtttgtagggggagggtaatagagtattaggtagcttttggaatacataggagtgtaactggaaaaagattccaagcaagtctaatgaattagataatttacctaattagtaaattatgtaatcagtatgctttataataatattgtgagttagatcctgtttctgatatgtacataccatattgtataggtgctactaatttggagagcatatacagtgagtccatgcctttttcctgccatcagcattataccaaaattctgccatggtttttaaactttgattctgagaaagtttctcaccctaataacataactatatttgtgtttgtcttcatagttaaatatgcattatgatatcagcttgcatacattttttaaatgacttgaatatctgactttaaaaattattctagaatttctgtgcttcaatattaatgccagaagacttggaattgtttatttgtaggtaactgcctttaaggaaacttgaccaaatattaactaagttatgtatttccttttggcaacagttgtgacttctcaccaggagatttggtttgggccaagatggagggttacccctggtggccttgtctggtttacaaccacccctttgatggaacattcatccgcgagaaagggaaatcagtccgtgttcatgtacagttttttgatgacagcccaacaaggggctgggttagcaaaaggcttttaaagccatatacaggtaagagtcactactgccatgtgtgtgtgtttgtgtgtgtgtgtgtgtgtgtgagagaaacagacagacaggcagacttttttctatatgatgaaattaagtgtattttaccccagtaaattgcaaggggtggcagttgtgaaagcttctggcatgggaaagggatgtaacatggtctttagctggtttgttttgtggaatggaatttttatttctgtcctttgagtgacttacagcaatattatacccttaataagggtaaactaaactgtccccccatcttgaagggtccaagagaaagttaatgtcatcaggatacatagcctatagatagcgacattctctagggaaagatggagatgcgcactacctggccttcaaactactcactaatgaacacatctgagttgagtttcacaccaaactcctggaaccataactttcttttcccagatctagtcttgtttatcacagacatcaacagcctggcatgtttagcctcacttgggctaggtgcaccccatcgtctcttgtacaagttctctttctttcttttttttttttttttttctggagacagagtctcactctgttgcctaggctggagtgcagtggcgcaatctcggcccactgcaacctccgtctcctgggttcaagagtttcctacctcagcctcccgagtagcttgggattataggcacacgccacgttgcctggctatatatatatattttttttttgagacggagttttgctcttttggcccaggctggagtgcaatggcgcaatctcagctcactgcaaccgccacctcccgggttcaggtgattctccttcctcagcctctaaagtagctgggattacaggtgcacaccaccaagcccagctaattttttatttctagtagagatggggtttcaccatgttggccaagctggtcttgaactgctgacctccagtaatccacccacctccccctaccaaagtgctgggattataggcgtgagccactgtgcccagccgcccagctaatttttgtatttttagtagagacggggtttcaccatgttggccaggctggtctccaacttctgacctcaggtgatctgcccatttcggcctcccaagagtctccagtctagtacgttgtcgtactcggtgttgtaaaatccaaacaagggtcagtttcccaggtaactgggaaattcccagaatcacactctttcgtcatagtgctcatcctacaaaaaaggattgggggcattttgtctaaaattaaatgtaaatggtgatctgacatacaggtggaaagagaattgggaagttttgttctctcttctaccaacttgccacataatcttggccaagcaaagtaacttgttttttcttttaatctttttaaaagaaatagagacacagttttgccatgttgcccaagctggtctcaaactcctgcctgagctcaagcagtctgcccacttcggcctcccaaagtgctgagactacaggcataagccaccatgcccctgggctcggccaactttttcgttttcttttcaagagatgggggtctcactctgtcacccagcctggagtatagtgttgggatcatagctcactggagccttgaactcctgggctcaagtgattcccccctgttttagcctcctcagtaaccgggactagaggtgtctgccaccacacctggctaatttttatatagttttttttttttttttttttttttaaagagatgacggtcttgctatgttgcccccagggtggtcttgaattcttggcctccagtgatccttctgcatcaggctcccaagtagttgggtgatctggctaaagtaacttattttctgatactgtttacttatatttagaatgaatctcattggggttgcactggggccgggcatggtggctcacacctgtaatcccagcgctttggaaggccaaggcaggtggatcacctgaggtcaggagttccagactagcctggcaaacatggtgaaatcccgtctctactaaaaatacaaaaattagctgggcatggtggcacatgcctgtaatcccagctacttgggaggctgaggcaagagaatcgcttgaatctaggaggcggaggttgcagtgagtcaagatcatgccaccgcactccaacctgggtgacagagcgagactgtctcaaaaaaaaaaaaaaaaaaaaaaaaaaaaaggctgggcacggtggctcgcgcctgtaatcccaacactttgggaggcccaggcgggtggatcacgaggtcaggcgttcgagaccagcctgaccaagatggtgaaacactgtctctactaaaaatacaaaaataagctgaaatcccagctactcgtgaagctgaggcagagaattgcttaaacctggtaggcggaggttgcagtgagccgagatcgcgccactgcactccagcctggggaacggagtgagacttcatctcaaaaataaataaataaataaataaataaaataaaataataaataaagtaaaaagatctctcattgaaccagatgatatatgaagtctcttttaggaccaatttcgagatttaaaaaatttggcagaattactttttttttttgcagcggagtccagctttatcacccaggctggagtggaatggcacaatctcagctcactgcaacctctgcctcctgggttcaagcgattctcctgcctctgcctcccaagtagctgtgattataggcgcccaccaccaggcccagctgatttttgtatttttcagtagagttgaggtttcaccacgttgtccaggctggtctcaaactcctgaccttaagtgatccgtccaccttggcctcccaaagtgctgggattaggtgtgagccactgggctggcccagaatgatttttaaaaagagatcagtaaggccaggcagtggtggctcacgcctgtaatcccagcactttgggagactaaggtaggtggatcacctgaggtcaggagttgcagacaagcctggccaacatggtgaaaccctgtctctactaaaaatacaaaaattagccaggcatggtgacacatgcctgtaatctcagctactcaggagggtgaggcagaattgcttgaacccgggagtcagtttcttttttctttttttgagatggagacccactttgtcacccaggctggagtgcaatggtgcagtcttggctcactgcaatctctgtctccggggttcaagtgatcctcctgcctcagtctccttagtagctgagactacaggtgtgcaccaccacacctggctaatttttgtatttttaggagagatggatgtcaccatgttggccaggctgatctttaaactcgtgacctgaagtgatccacccgccttggcctcccaaaatgctgggattacaggtgtgagccaccacgcccagccctaaagttgtattttgatggaacgaactgttttgagaaataaattttaacgcgttgagtctgaactgggctgccctttcaaaatgtgaaggccccttaaagtagcacattggttggttattcttttatttatttagatatatctgatctagttgtctttgggacaaactcatatttaatatcatagctgcatgtaactgacagtgtagtctttgtcttcctgaagtgtttgtttgttttttgagatggagtcttgctctgtcgcccaggctgaagtgcagtggtgcgatcttggctcactgcaacctctgcctcccgggttcaagtgattctccttcctcagcctcccgagtagctaggactacaggcatgtgccaccacacccagctaatttttgtatttttagtagagatggggtttcaccatattggtcaggttggtcttgaactcctgacctcgtgatctgcctgcttctgcctcccagagtgctgggattacaggtgcgagccattgtgcccagctagtaagtttttaagaaagattctcaaacctcttttaaatcgtctgcctcacttgaagaggtatgccctacctgtttagggctgtagacccaggtcattagaagacagactaagtagtcctgggtgaacccatagggcaccttcaaggaggtaaaattggtgattttagtttcaccagtagtttttccctgaatatttattccttttgtgctttattgatctatctatatcaataaaaagtaatggggcataacaaattatacttgtcattcttgttcattagggcaaatgttgtaggttgagtcaagtgtccagccaacaagttattttatgtgtgtgtgtgtgtgtgtgtgtgtgtatacatatatacatttttttttttttttttcatcgagacagggtcttgcactgtcgcccaggctggagtgaagtggtgcaatctcggctcactgcaacctctgcctcccaggtttaagtgatcttcccacctcagcctcccaagtagctgggactacaggcgcacaccaccacccttggctaatttttgtattttttttttggtagagatggggtttcaccacattgcccaggctggtcttgaattcctgacctcaagtagtccgcccacctaagcctcccaaaatgctgggattacaggcgtgagccaccacacctggcatatatatattttaagatagagatggggtttgctatgttgcccaggctggtcttgaactgctgggattacaggcgtgagcctctgcacccggcccttattgtttataaatacatttctttctaggttcaaaatcaaaggaagcccagaagggaggtcatttttacagtgcaaagcctgaaatactgagagcaatgcaacgtgcagatgaagccttaaataaagacaagattaagaggcttgaattggcagtttgtgatgagccctcagagccagaagaggaagaagagatggaggtgggacacggcaagcattcagttgttatttatgttagggtgatgggggaagaaagggggagggtgtattaacaagataccttgttttatatatgtgtgtgtatatgtattattttattatacatacatgcatacttctgtagttccctggactgtaggataagttaggttacttagaatctcaacagctagcatcgtttttacttaggttttcaagcctactggcagggtaagcaagaggtagtaccattttggtaagaagtagagagctagggacagtaaagatggagtaatatatatatgagggtatagtcaggccctagaaattaattatccagttttatgctttttataaaaaaactgagatggggtcttgctatgttgcccaggctggtctcaaactcctgagttcaagggatctgcccacctgggcctcccaaagtgttgggattacaggcatgagccacagcacccagccccagctttatgcttttaattctaaaactttttttgttgtattttgcattcataagaatagatgttaaataaaccttgaaatacaaccttggctcaaacgttaatggtcatggataaagtgaattaaaacttgttaggggccaggtgtggtggttaatgcctataatcccagcactttaggaagctgaggcagttggatgtcctgaggacaggagttcaagaccagcctggccaacacagtgaaaccctgtttctataaaaaatacaaaaattagctgggcgtggtggcacacacctgtagtcccaaccacttgggaggctgaggcatgagaattgcttgaacttgggaggcagagggacttgggaggcagagggtgtagtgagccaagatcgcaccactgcattccagccagggtgacagagcaagaagactgtcaacaacaacaaaaaatgttatagaagtgaaaaaaattgattaatttagaacaagcttgtccagtctgtggcccaggatggcgtttaaatcagcccaacacaaatttgtaaactttcttaaaacattttgtgatttgttgttgttgtttagctcatcagctatcattagcattagtgtattttatgtgtggcctaagacaattcttccagtgtggcccagggaagctgaaagatcattatcctctgatctatcatattaatgagctgcatcctaaaagacattcatctataactaagctcagtttcatgttttgttcctttttcaatagataagatagggaatgagcaagttaataaagtgggtattttaattttaaggttgaaactaaggatcataacattatcagaggtctagaactggatggcagctacagagatcatttagcctaatactggtttaacaaataatccgggagatccgtgatatgtgaatgtgctaggcctgagatgagacagccaattgtggaagagcaaacactagaaccagtataagttgcttactgctttcttatgctattaatgagcatatcgcctcctgatatttatgatatatggtcatgccaacagctttgtcataaatagaactcccatggcagcaatcacttaatcttgtagttagaggtggggtctcaccatgttgccgagctggccttgaacttctgggctcagcgattttctccacaggcacctgctactgtgctcggtgcagcactttgtgtttttgaacataacctcaagatgttattgtcttcatagtaaaacaaaagatgaggcttagaactggatcactttgcctgtctcttcttacctcctcccagttcaaaatgcttgcatctcttaatagctagcattcccttggattttgcacatgagctcaaactcaagcctcagcacaatcttttttatagttttagtcttttagccagagtcgacttaccccccatacccactctgcttccttcataatgctgctttccctgggcagagaatccttgcccttcttgtattatgtcactttgtggggttggtgtctgctacacttacagcaagtccagagattttttttccaccacgtttgcaggagaactattggcatggaaaatgacaattgttttaatgtcaagtgaaactgaagttgatgttcattgagaggtttctaatttctagaggtgggttctttttttggcatatgaagttgcagcatattaagagaatttacagtagtacagatggggttatcccatccacaacttatgatggggttacataaactaaaaacgtgtttaatacacctaccccaccgaatattgtagcttgggcgtagcctaacctatctcagacgtgctcagaacacttaaatgttagcctaaagttgggcaagatcatctaacacaaagcctattttataataaggaattgcctatctcatgtaattcatcgaatactgtactaaaaatgaaaaacagtggctgcacgggtaccattataaagtcaaaaaatcataagttgaactgtcttacattatggttttccaaattttgatttgtttttaaatactctttccttgcctggcaggtaggcacaacttacgtaacagataagagtgaagaagataatgaaattgagagtgaagaggaagtacagcctaagacacaaggatctaggcgaagtagccgccaaataaaaaaacgaagggtcatatcagattctgagagtgacattggtggctctgatgtggaatttaagccagacactaaggaggaaggaagcagtgatgaaataagcagtggagtgggggatagtgagagtgaaggcctgaacagccctgtcaaagttgctcgaaagcggaagagaatggtgactggaaatggctctcttaaaaggaaaagctctaggaaggaaacgccctcagccaccaaacaagcaactagcatttcatcagaaaccaagaatactttgagagctttctctgcccctcaaaattctgaatcccaagcccacgttagtggaggtggtgatgacagtagtcgccctactgtttggtatcatgaaactttagaatggcttaaggaggaaaagagaagagatgagcacaggaggaggcctgatcaccccgattttgatgcatctacactctatgtgcctgaggatttcctcaattcttgtactcctgggatgaggaagtggtggcagattaagtctcagaactttgatcttgtcatctgttacaaggtggggaaattttatgagctgtaccacatggatgctcttattggagtcagtgaactggggctggtattcatgaaaggcaactgggcccattctggctttcctgaaattgcatttggccgttattcagattccctggtgcagaagggctataaagtagcacgagtggaacagactgagactccagaaatgatggaggcacgatgtagaaagatggcacatatatccaagtatgatagagtggtgaggagggagatctgtaggatcattaccaagggtacacagacttacagtgtgctggaaggtgatccctctgagaactacagtaagtatcttcttagcctcaaagaaaaagaggaagattcttctggccatactcgtgcatatggtgtgtgctttgttgatacttcactgggaaagtttttcataggtcagttttcagatgatcgccattgttcgagatttaggactctagtggcacactatcccccagtacaagttttatttgaaaaaggaaatctctcaaaggaaactaaaacaattctaaagagttcattgtcctgttctcttcaggaaggtctgatacccggctcccagttttgggatgcatccaaaactttgagaactctccttgaggaagaatattttagggaaaagctaagtgatggcattggggtgatgttaccccaggtgcttaaaggtatgacttcagagtctgattccattgggttgacaccaggagagaaaagtgaattggccctctctgctctaggtggttgtgtcttctacctcaaaaaatgccttattgatcaggagcttttatcaatggctaattttgaagaatatattcccttggattctgacacagtcagcactacaagatctggtgctatcttcaccaaagcctatcaacgaatggtgctagatgcagtgacattaaacaacttggagatttttctgaatggaacaaatggttctactgaaggaaccctactagagagggttgatacttgccatactccttttggtaagcggctcctaaagcaatggctttgtgccccactctgtaaccattatgctattaatgatcgtctagatgccatagaagacctcatggttgtgcctgacaaaatctccgaagttgtagagcttctaaagaagcttccagatcttgagaggctactcagtaaaattcataatgttgggtctcccctgaagagtcagaaccacccagacagcagggctataatgtatgaagaaactacatacagcaagaagaagattattgattttctttctgctctggaaggattcaaagtaatgtgtaaaattatagggatcatggaagaagttgctgatggttttaagtctaaaatccttaagcaggtcatctctctgcagacaaaaaatcctgaaggtcgttttcctgatttgactgtagaattgaaccgatgggatacagcctttgaccatgaaaaggctcgaaagactggacttattactcccaaagcaggctttgactctgattatgaccaagctcttgctgacataagagaaaatgaacagagcctcctggaatacctagagaaacagcgcaacagaattggctgtaggaccatagtctattgggggattggtaggaaccgttaccagctggaaattcctgagaatttcaccactcgcaatttgccagaagaatacgagttgaaatctaccaagaagggctgtaaacgatactggaccaaaactattgaaaagaagttggctaatctcataaatgctgaagaacggagggatgtatcattgaaggactgcatgcggcgactgttctataactttgataaaaattacaaggactggcagtctgctgtagagtgtatcgcagtgttgggtaagactttgaacaagcttgttctcaggctttgataagtagtgctgtttgccagctgtatattatccctaaaaataagtaataaggtatatatggtacatattttgacatgcatatacatatttgcatcctgactaggctgcccacagcaatttaagttacttgaaactcgcttttatcttagtagccctttggcctttcttcagtttttttttttttttttttttttttgagacatggtcttgctctgttgcccaggctagaatatggtgacacaaccatggctactgcagcctcgacctcccaggcttaagtgatctttccacctcagcctcccaagtagctgagattacagatatgcaccaccatgcatggctaatatttaaatgtttgtagagagatggggtctcactgtgttgccaggactggtcttgaactcctgggctcaagtgatcctcctgcctcggcttcccaaagtgctgaggttacaggcatgacccattgcgcctggccctttcttcagtctttaataatcgaacaaaaggtttttgtttttagacagtgtcttgctctgttacccaggacagacctctcgtgtcagcctcttaggtagctaggatttacaggtaagcaccggcgtgccctgctttatttttttggtgggggaagggggaagggagttgaagcttccctatgttgcccaggctggtcttgaactcctggcctcaagtgatcctccagtctcccaaaagtgctgggattacaggcatgagccaccgctcccggcccaaaagatttttaaatgtgttatacttcatgagacaggctttattttagatcgaattttatttatcaataaaaagttgagctttttattatttggtgaatactgtttcaaggtgctttgttacactatctgttgatccaacatttaaaaattgttttattacaacctttgcatttcagtgaatccatctgcatacaattttaaaagaatcattccttttttctgtagccaaattgtcaaagattctttcctacaattgatttttcaaagccctgagttaggaatttacaatttggcaaccatctcaacttcataagcaattttgttctttaaatgtcacggccaacattacctggaaccattgctgttttatagtttaggtttatgttgtatattttttttaattttttagagacggggtcttgctgttttcagactggagtacaatgggatgactagctcactgcagcctcaaactgctgggttcaagtgattctccttcctcagcctcctgagtagctgggactacaggtggtcaccatcacacctggctaatttttgtatttttggtagagacagggtttttcccgtgttggccaggctgttcttgaattcctgacctcaaagcgatctgcccgccttgatctccgaaagagctgggattacacgcatgagccactgcgcccagccctgttttttttttttttttttttttaaataatggtagtttacttgaatttgtaacacagtaacacaaaactattttgatctgaacgcaagtatctaatggaacagaataatatacttccttttagtgtgctgcatttggttactgggtaatttaaaattcttcctcagcacaggtgttcaaaaaccagtcttcagagattgttttcatatcagtgtgccaactttggcacattctgctaagtaagaggcttaagtgtagcatgtttctgctgttttgtgtttgttttgttttgttttttgagacagagtctctctgtcgcccaggctggagtgcattggtgcgatcttggctcattgcaacctctgcctcccaggttcaagtgattctcctgcctcagcctcctgcgtagctgggattacaggcatatgccacgtgtattaggcactgctaatttctgtatttttagtagagacgaggtttcaccatgttggtcaggctggtcctgaactgctgacctcgtgaactctgcccgcctaggcctcctgaagtgctgggattacaggcgtgagccaccgtgcctggcctctgctctatcttttagctttcccttggcacttctatggtccagatgttagagggtaagtattttgatgggggagatcgttggactgtaattgaaagttatgtcttataatgaaatgtgttatataaagaagacctataaaacacttaggctgataaaacccccaaacgatgaagcctcacttttaccctctcttttaacagatgttttactgtgcctggctaactatagtcgagggggtgatggtcctatgtgtcgcccagtaattctgttgccggaagataccccccccttcttagagcttaaaggatcacgccatccttgcattacgaagactttttttggagatgattttattcctaatgacattctaataggctgtgaggaagaggagcaggaaaatggcaaagcctattgtgtgcttgttactggaccaaatatggggggcaagtctacgcttatgagacaggtaactgattcttaaagttttgttatcagaaagtcatttgtgacattaggaataacatacttaggtgatcattttccaaacacagttacataaaagtcagccagtgacttaataggaagcaaagggaaattactccctgtgttataaaattgagaattatatttagctgaaacatcgatgcttaatgttaaggggaatatatgttaaaaaggggaaggaggtcagtcattcaggtcatgaggccctttgacttgaattcatttcctcagaaggtaggtatattcatagtgaacaaaaatacaaaggctgtatgaaaagatgaaaatgttacaggtttatccttaaattagactcatttgcagaaatgcaaatgaggtaagaaagcaaatatagttcatgacctctagcaactgttgaaaactgctctttagggatgacatgctggcccttttttttttgttgttgccaaggctgaagtgcagtggcaccatcacagctcactgcagcctcgaactcccaggttcaacccttcctcctgcctcagcctccccagtagctgggactacagatgtacaccatcatgcctagctcatttttaaaaaaattttttatggcattgtatttatcttctctttataaccaggggttgaccagccacagaacttgtaaagttttttatatttttaaaaggttgtaagaaatagtagtagttggctggtccccgctgctctcctgcattatagtatacttctgttcacctagtttgctagagagaggcagtatagtgtgtatagtgatttccaaactttttctttaaatcagaatcacctgaaagaatgtgacaacgtgtaaaaaaaaaaaaaaaggtgcagagattccatcctgacatggattcacttgattggaattgattctaggcatctcagtagttttaaagagctcctaggtgattctattctggccagcgttgagaatcactagggtagtgggttggtaagcaggctctgatgttttaaaggccaggtgaggccctatgcctcttgtctctcttagcctcaactttctccatgttagcaaatggatttcagaacagaaccaacgtacatgtgattgtgaaagttgttttagagtgcctagctcttacgtaagggttcataagaaagacaaaagtttatgaaactgttactaccagtcataaaagaccttttcctccctcattcacaggctggcttattagctgtaatggcccagatgggttgttacgtccctgctgaagtgtgcaggctcacaccaattgatagagtgtttactagacttggtgcctcagacagaataatgtcaggtgagttttttgtttcccacttaagttctcattcagtcatttagatgtgataaaagatatttgcttcttgtatatgagccttttaaatctaatatttgatttttctggtgttactttaaaaacatcactttttaagaactgcatagtctctctctcttttttttttttttgagatggagtttccctcttgttgcccaagctggagtgcaatggcacgatcttggctcactgcaacctctgcttccaggttcaagtgattctcctgcctcagcctctcgagtagctgggattacaggcgcatgccatcacgcccagctaattttttgtatttttagtagaagcggggtttcaccatgttaggctggtctcttaactcctgacctcaggtgatctgcttgcctcggcctcccaaagtgctgggattacaggcgtgagccaccgtgcccggccaataattgcatagtctcttaatgagatttaatcttttataccaatatgtgtagctcatgatagctatataacctagaagatgaatttatgtaatatgatttgcaaaatgagtattcatttgtgatttttttttttttaaggtgaaagtacattttttgttgaattaagtgaaactgccagcatactcatgcatgcaacagcacattctctggtgcttgtggatgaattaggtaagacattaaacttctcatttgaagactatctatcttaaaaacatttgtacaaataactatttttatagaagattatctgaagtacatttaaacaatatgaatgtttttagagcacgcactcaccattgtggcacagaccgatagttggagataaaaggtgatattgtgaaaggtttttgattacccattaattattaggccttacactgtttagttgtaataaaacatttgttatactacggggatgagaacactaataggaggactcaggaagtttatgaccttgagcgatactgtattttctttaaaagaaacctcactccccatgggctgctaagcagactcgtgtagctaaacaaggcctatttatagaatgcttttagacgtggatgtactaaccgatgttgcttttctgtcctagcatttttgttttaattccttttttgttttaattcctttgagttacttccttatgcatattttactttaacaggaagaggtactgcaacatttgatgggacggcaatagcaaatgcagttgttaaagaacttgctgagactataaaatgtcgtacattattttcaactcactaccattcattagtagaagattattctcaaaatgttgctgtgcgcctaggacatatggtatgtgcaaattgtttttttccacaaattcggttttttgagagggcacttctcttgctagcacatgtatcgctaatatttttctttcttaaggcatgcatggtagaaaatgaatgtgaagaccccagccaggagactattacgttcctctataaattcattaagggagcttgtcctaaaagctatggctttaatgcagcaaggcttgctaatctcccagaggaagttattcaaaagggacatagaaaagcaagagaatttgagaagatgaatcagtcactacgattatttcggtaactaactaactataatggaattataactaactgaccttaagtttcaaagaaacagtaaaaggggaagggatgatgcactatgaaaaaacaaaaaaacttttttttttttttttttaattttaagggaagtttgcctggctagtgaaaggtcaactgtagatgctgaagctgtccataaattgctgactttgattaaggaattatagactgactacattggaagctttgagttgacttctgacaaaggtggtaaattcagacaacattatgatctaataaactttattttttaaaaatgaccatttttccattttctttctaggaaattaaacccttttaattcttatctaccttctacataatggttattgaatactccacaatatattaagtctagatgttatggtacatgcatacactttcaggctgttttatacccactgtcaccaatacacataaatgggggaggaaaagctatgaaactgtatagggctgtatatatacttgtctcagcttaatgcaggaaattggtttaatttccagcagttttgtctaaactgttcaaaaaaaaactatgaacagagttcaaatacaggactgtttgttttgaagagactttctaaagtgtacttaaaacatagtagttttttacctttcacaaaactgagttacaagaatacttttgttttacagtgcatcccttcctaggaagtctcattaaaacactcactttttctaggggtgattttgaatgctgcacagggaagggaaggaaataatagtcttaacttttcttaaaggataccagaaacattgctggatataatttaagattagtgttttctctttcatagaaagaacgtacatactgggacatgagtacagttacagcaagtctaggtgtgctaacaaaacagggcacattcaagtacagtaagattttgcttgaaattaaaaacaaactacatgagattaaagcattaaaatcatatttctcaatctgaatacatgttaaaaaaaaaaaatcaaaaggaacgcagaagtgctagctcacatttttaccatattacaaaagcaattggtacccatgtccataaaggcagcaacaaagctgcttgtctattgaagattactactgcaaattggactgcattcaatgctagttgtaaaaacaccagcttttcagaagttggtatctgtacaaaattgcagcttattttcttcacttctgtcccttcaagtctttacacagtaatgctaaaacacccagctttgagatcctgagtcaatatattgccactttctttttggtagcttgagcttcatagtgtcaactgaccttgtgtatccatttttaatacagtctcttcctgtagcatgggcaaatattttaaatcttcttccaaaaaagtgttttaagttatgatgttacaatggcaggactttttctttagggaaggaattcagttgtgctgcaatgtattagattctataggtggagcagagtcatatagtgtatctgtatcatgtgtaggctcaccagctaatgtacaaggattagacagtgttccagcaccacagtcacagaaaaacctaaagcaaaatgaaacccaaatattagaaaagtgagggggaaagtaattgggtaatatatcaagcaagtgtgctacatacctatcatgtctaataaactctacatcatgtccctgatggcacttcttaatgcagttcacacatatggcatttcgatctgtggtgttacaagtatgacatctaaaaagcaaaagcttaaattacttttctcaaacatgtcattaatgcaaaacattccattctgtttatatattactatgacctttggctttaagaggaccaaaacaaaattctttgtggctccagcccagattaattctgaaaaggaactttaatggagtaagtgattttcctgtcatctgtgtcttcggagggaagagaaatgatttgtaaattgtataaaggcagttctttccactttaaaagcctctcaaatgtttctgggctgaaaacaatttttggaggcgtgaagagtcaaaactgtcacagtgactgggatatatcaaacacttaaccccgacatctttaccttgaaatttctaggaaaacattacacaacatgagttacatgaatgacatcagttactgtagcattaggtttttccatagttatggtctttgttttgttttgtagagacagggtctccctatgttgcccaggctggtttagaactcctgggctccagtgatcctcccacttcagcct

SEQ ID NO: 38 - DNA, 79540 bp, Homo sapiens
aatgccatttagtcaaagaggaaacatgagaggaggagcaggattgggggcaagatcaatgacatgtagtgcctgagacagcaaagagcatttgttagcaattagatacatcaattagggaagatctagaaaggagatatgaatctgacagtcatttgcatataaatggtaaggaaaccatggaaggaaatgagatcagctagcgagctgacacagaacaaggcagtctaaaacaaatttttttaaaaatacgaagaacagatattgaagggaagaggtgcctgcaaagactaagaaagcacacctggagatggtatctcctcaaagctaaagtcatcaagtgttcaagtgtttcaaggagggtaagactattaacaaggacttagcatagtagagcaatttgagtggcaatacgggacactgggaatacaaatctgtcaagaaaactagtaggaatgagctataggacagtaactggtaaggacctaataattttttttttaatgtacgtattttaactatattcactgctacaacaggaccagtaacaactatatttatttaaaaaaaaaaagactgccatgcagttacagaattacttaatacagaaaacagtaaaatacacttttttctttttctttttttttttttttttttacaaacaagactagcttatagcaaattctctatagctaagggtcaatttaaaatccttggcttatatctccccctcactcaatgactacatgatgcaaactaattttattaacaccttaagcaaaacatactggaatttcacaaaatgtacaagatttcaatatttaaggaactggggttagaaagcagaagtggctttcaggtcttccagtctttctctcaagtaataaagctctgctgtgaatattcaaagctattgggaaattaccggtagatttttctgtttttttttttcggttttccactatgttgtttctctagatatgtaagcttactctattaaccaaaatctcagcttgaccattcttgataagtacctaatcgacatgtaactttttttctgccttaaatatgtataacaggacagagcccttaaatctgattcaattattaattcctgatttacaagtgctatggtgagctaacagaacttatcaatgcctttattgcactttactagccaaatttagaaggttggaattagtctctcctatctagtattctgtcagtttgcccagcttgtacttttaattttgcttctaatggtaatctgccctatcccttgaaataaaataatctacattttgggagggctaattcttcattgtgccaggctgtcccatgcactgcaggggtgagtgtctttaggcttaaatgccaacagaagcccctagtaaatatgacaaccaaaaaagtgcccctacacatttctcagcatcctctggaatgacaggttactgcctctagttgaaagccactggcacaactttggtttttaagctcttatgccatttattttaattgcccagacatcaattccacctaaattcttagtcatagcctggttccttgaatttgctggattagtaaccacagattaaggtgtttcaatagttaagacaggactttggaacaagagtttttaaattgtataatacttgagaggatctatgaatataaattgggtcctgtttataattagttttacataatgaactttaagattgccttttcatggtgaacagaagtttggaaattactgttttggcacaaagcagattatcttagtagaaatacagaattactgcaatctgtgaataagactgcttttaaatatttctacttgtgtgctatcttacatatagaatgtgtacgacagttccaaattttagaataaatccatttctagcatctaacaaaatctgatactgtatcattttaaaacaaagtgtttactttaggcaggattttttaaaataaagcagcaatacccacgcagataagacaaaaaagctaaaatatctcacacctcctaatcctggagtgcaatcttttttcctcatcgtttttgatagggccaaacttgtgtctacagtaaaaaaaaaaaaaaaaagaattactaactggcaaccattaagattctatacttaccatagtcctttaataggcaagctgataaaatagcccccagttattaaaaaaaaaatccaaggaaaacccccaataattagtcttatctccaaattgcatgaagtctcctatatctgaaacttaaaaatgattctaatgacttcctctatcagtaatgtgttatcactgaggtgggtgatggggagggaagagggaagaaatctgtcagtattaccttcgaactcagaaatgtttaaaaaaaagtctcaaacattttgatggttagacaaaacacctccactgttatgtatgggcttcctttttggaaacttatgaacttgctatgtgagcttctgcaaattggttcaaaagcacatttaaggagttgataatttaagactatatgaatcagaattttaacactccattaaaataagagctgaaatttttggcatttatcttcagaacacctaaaaaacagactgcaaattcaactcacattaatactaaatctctttaaaattaactatatcataaaagacaatgactttgtcactaaactaagttttaaaaaaggtggcattctcatgtttcagtcccatgctgccatttgagatgaaaaaaaaggcaactgtcagaattttaattgtgatcagtttggacggctggtacttggtactttctcacaatccaaattagtaaacttgaaaactcaaaccaatttttgcttttagaattaaattcttgttgagtttttcaatcttgtactacaaagccttatggattagattcatttctttctctcacaaggtcatcccaaccgggctccatttcagttgtggcaacccgaaacagggcttggagatgctcatctgttaatggctgactcaaagtgtgttggtttcgagtcaaatatgaaaaagccttttcacagatttggttactatcaaacaaggatgccaccttacaggcaacccctttgataattgggtaggattcagcagacaatccagcataaaactgccccaagtctttgattctgtattcattccaaagattagtgtttgcctgaagttttgttagctccaccctcactgaaataggtgcatattcaggtttaaagttaaatggatttgaaaaaagttctaagtcctttttaatgaacctgaggtccttaaaatgtctctcaaattctttttggagacgacagatcaccatttgatacctatcaggatcaaatattttttcatcttccttattttgctgttttagctcatcaacaacttctctgagggcaggaaagtctgttagatttttttcctcaatatgtctttgaaataaattcagcttaacttcgaaagtacaaatatggtcaaaggcagcagcagcaaagactttactaactcgtaattcttcactgagttctcgaaggtgttccataatgtccaccaagaagccaaagtcacaaagccattgtttgtctgagaagtggactgttgttgcccctactgaaaccaagaacgcttccatttcttttcttagagagaatattagttttaaagttttccctctcctaagccaattgttcagacatcgtccattaaccctttcaccatgctctgattcagattccgttagtaaagtctgaaattcaggtcgcctaacgcctctggtcttaatcaaaactatccattcggatatggtatttatgatctgattaacatctacatcataggagctcaacagttccaagtgaagaaatcctgaataatgaatgacattccaacagttggggcttacggccttttctctcatgtatgagacgagtcctgagttctcaccaatcatcctcaaagtatgggtcgtggtcagtccaaccattctctgcaagctaagccctgctgtctgcagggactctaggattgccgacatgagcgcaccaacactgaaatgatgagtcaggttgattatggtcagaagatcttcttgcacctccaactcagggcctacaccgcggataaagaccaggaggtagttctcataggccacaaaagcctggtcgtccaaggcaagagaataggctttaaagtccctggctcggttaaaaagctggttgcgtagattcctgtcaatgctcaggatcctctgccttgtgatatctggagataagtcaacgccttgcaggacgcttacatgctcgggcagtacctctctcagcaacacctccatgcactggtatacaaagtccccctcaccccagccgcgacccttcaaggccaagaggcggcagagcccgaggcctgcacgagcagctctctcttcaggagtgaaggaggccacgggcaagtcgccctgacgcagacgctccaccagggccgcgcgctcgccgtccgccacataccgctcgtagtattcgtgctcagcctcgtagtggcgcctgacgtcgcgttcgcgggtagctacgatgaggcggcgacagaccaggcacagggccccatcgccctccggaggctccaccaccaaataacgctgggtccactcgggccggaaaactagagcctcgtcgacttccatcttgcttcttttgggcgtcatccacattctgcgggaggccacaagagcagggccaacgttagaaaggccgcaaggggagaggaggagcctgagaagcgccaagcacctcctccgctctgcgccagatcacctcagcagaggcacacaagcccggttccggcatctctgctcctattggctggatatttcgtattccccgagctcctaaaaacgaaccaataggaagagcggacagcgatctctaacgcgcaagcgcatatccttctaggtagcgggcagtagccgcttcagggagggacgaagagacccagcaacccacagagttgagaaatttgactggcattcaagctgtccaatcaatagctgccgctgaagggtggggctggatggcgtaagctacagctgaaggaagaacgtgagcacgaggcactgaggtgattggctgaaggcacttccgttgagcatctagacgtttccttggctcttctggcgccaaaatgtcgttcgtggcaggggttattcggcggctggacgagacagtggtgaaccgcatcgcggcgggggaagttatccagcggccagctaatgctatcaaagagatgattgagaactggtacggagggagtcgagccgggctcacttaagggctacgacttaacgggccgcgtcactcaatggcgcggacacgcctctttgcccgggcagaggcatgtacagcgcatgcccacaacggcggaggccgccgggttccctgacgtgccagtcaggccttctccttttccgcagaccgtgtgtttctttaccgctctcccccgagaccttttaagggttgtttggagtgtaagtggaggaatatacgtagtgttgtcttaatggtaccgttaactaagtaaggaagccacttaatttaaaattatgtatgcagaacatgcgaagttaaaagatgtataaaagcttaagatggggagaaaaaccttttttcagagggtactgtgttactgttttcttgcttttcattcattccagaaatcatctgttcacatccaaaggcacaattcattttgagtttctttcaaaacaaatcgtttgtagttttaggacaggctgatgcactttgggcttgacttctgattaccctattgttaaattagtgacccctcttagtgttttcctgtcctttatttcggaggacgcacttcgaagataccagattttatgggtcatccttggattttgaagcttataactgtgacaaaaaatgtgaagggaagagatttgaaacatgtggaaggaaaagtgagtgcagactataaacttccaaaaagacaagcccaaaatacacctaaacgttatgtcagattattttgttaaaatcagttgttagtgacgtccgtacgttaatagaaaaaagaatgcttcagtttggagtggtaggtttctagagggatttattgtgaaagtataaactattcagggcaatgggactgagagaacagtgggtagaaaggaccactgaaggaaaggaagagaattggaaggtagatgaaagaaggagcaagaacctggggatgttttttccttttcacttgtaatagtagtaacagaagcaatggcagactggcttttgtttctactgtgttagaatgaattgacaggacaactgggcctattattgtactgtgccagaatactgtaaaacaaaactaaacatactagcttggtggcttgtaattaattacttaagtggagatttttattttttttttattttttttttagacggagtctcactttgtcacccaggctggagtgcagtggcgcgatctcagctgactgcaacctcctcctcacaggttcaagggagattctcctgcctcagcctcccgagtagctaggactataggcatgtgccaccacacctggctaattttgtatttttagtagagatgggatttctccatgttggtcaggctggtgtcaaaactctcgatctcaggtgaaccgcctgcctcagccttccaaagtgctgggattacaggcgtgagccaccgcgccctgcagttttttgtatttttaatagagacagggtttcaccatgttagccaggatggtctcgatttcctgacctcaggtgatctgcccgctttggcctcccaaagtgctgggattacaagcatgagccaccgcgcccggctcaagtggagatttttatatggagtccagttatactctttttaatatataagttgagatgactaatacaacttcaatacaggggctcatgagaaatgtctgtaatatttaagtaacttattgtcttctttcttttttttttaagatgaagtcttactctgttgcccaggcggaagtgcagtggcgtgatcttggctcagggcaacctctgcctcctggtttcaagcgatcttcctgcctcagcctcccgagtagctgggagtacaggcgtgcatgaccacacccggctaatttttttatttttagtagagacggggtttctccatgttggccgggctggtcttgaactcctgacctcaggtgatccgcccacctcagcctccccaagtgttgggattacaggtgtgagcccccgtgcccagcctattatcttatttctgaataaagaattgtctgtgtggggaatagataactctttctcatgcagcccctgctagaaaatttgttttctctagcagttggtctgtgcttataggctactctttgaaagcacaaaaaatttattgacttcttttttttgggtttttttttttttttgagacagagttttgcccttgttgcccaggttggagtgcaatggcgcgatctcagctcaccgcaacctccacctcctgggttcaagtgattctcctgccttagcctcctgagtagctgggattacaggcatgcgtcaccatgcctggctaattttgtatttttagtacaaatggggtttctccatgttggtcaggctggtctcaaactcctgacctcaggtgatccacccgccttggcctcccaaagtgctgggattatgggtgtgagccattgcgcctggccagaaaattcattgacttcctaaagatttattaactttctgcattacttttttttttcccctccatcgtaaatataaaagggaatagtagagaaaatcattcagaattttattttttagtgacattatttagtgacattttattagagtcacttaggaacctgaggctgaataaagttcaggtaaaagtaaaattagttgagaagagacatctgccaaaagaaatctatttttaacttcacttgctgtctttcctagaggaacagaaatagtgctgaatgtcctattagaaatgatggttgctctgcccgtctcttccctctctctcacacaatatgtaaactcatacagtgtatgagcctgtaagacaaaggaaaaacacgttaatgaggcactattgtttgtatttggagtttgttatcattgcttggctcatattaaaatatgtacattagagtagttgcagactgataaattattttctgtttgatttgccagtttagatgcaaaatccacaagtattcaagtgattgttaaagagggaggcctgaagttgattcagatccaagacaatggcaccgggatcagggtaagtaaaacctcaaagtagcaggatgtttgtgcgcttcatggaagagtcaggacctttctctgttctggaaactaggcttttgcagatgggattttttcactgaaaaattcaacaccaacaataaatatttattgagtacctattatttgctgggcactgttcaggggatgtgtcagtgaataaaatagattaaaatctattctcttctgatgcttacattatagtggtgggagacaaaatgggtataataaatattatattagatagcattaagtgctgtggagaaaactaaagcagggaggaagataggagtgtgcaagccagaaaggttgcaattaaattgagtagttcaggaaggcttcaatatggatgtgatatttgagagaccggtggaagtcaaggagcaagttgtgaggctatttaaaggtattcttggcttacagaacaatatacgcaaagactattaaatggaagcatacctgacatgttaaaggactatcaaggaggccagtttgtctagaggctgaaaaggaaagagtaataggagatgaggtctgagtgaaaacacgtaaatccttgtgggccaaggtaaaatctttagctttttttctgaatatggtgggatactgttagagggttttaagcagaggttacgtggtgtggtgagttttttttttttaatcctttgtctttctgtgtggaaaatagcaggacagggcagaagcagtctgtcctgcagactgcttggtcgcagtagagatgtaagaagcagtgagattctgggttaattatggaggcaaagttctcagaatttgctgatatagggtatgagagaaagaggaatcaggaatgatttcaaggttttggtctgctaaatggaaggagttgccatttactaagatgggaaagactatgaaagaagcagattttcagagagatcagaagttcattttggggcatgttcaatttaagatgcctgttagttggatgtttatgtgagtttggaatgcagggtagagatttagggatgaatatttggtagttgtctgcattttaatggtattaaaagccacgagaaggatgggcatggtggctcacacctgtaatcccagcactttgggaggccaaggcgggcagatcacctgaggtcgggagttcgagaccagcctgaccaacatggagaaaccccatctctactaaaaatatataattagccgggcgtggtggcacatgcctgtaatcccagctactcgggaggctgaggcaggagaatcgcttgaacctgggaggtggaggttgcgatgagccgagatcgcaccgttgcactccagcttgggcaacaagagcaaaactccatcaaaaaaaaaaaaaaaaaaaaaaaaaagccttgagactcacctgaaaagatgctcaacattattggtcattaggaaaatgaatgaaaaccacaatgagataccacttcacacctattaggatggctattatcaaaaacaaaaacaagtgtttgcaaggatgtagagattggaattcttgtgtattgctagagggaatgtaaaatagtgcagggtgctgtggaaaatgctgtggtgattcctcaaaaaattaaacataattatataatccagtaattccacttctgagttattcccaaaagaagggatgcaagcagatatttgtacactcatattcatggcagcattatttacagtagccaaaaggtgaaagcaacctaagtgtccgtcagtggatgaatggataaacaaaatggaataatttcagccttaaatagaaataaaatgttgacacatgttgcaacatatacgaaccttgaagacatcatgttaagttaaataagttggtcactaaaggacaaatattgtatgattccccttatgaggttcctagagtagtcacattcatagagacagtagagtggtggttgcccagggccggggggagcgaggagaatggaaattattgtttattgggtacagagtttctgtttggggaagatgaaaaaattctggagatggatcatgatgatagttaacacagcagtgtgaatatagttaatggcacagaactgtacatttaaaaatggttaagatggaaaattttctgttacatatattttactgcaatttttttaaattttattattatactttaagttttagggtacatgtgcacaacatgcaggtttgttacatatgtatacatgtgccatgttggtgtgctgcacccattaagtcatcatttagcattaggtatatctcctaatgctatccctcccccctcccccaccccacaacagtccccagtgtgtgatgttcccctttctgtgtccatgtgttctcattgttcaattcccacctatgagtgagcacatgcagtgtttggttttttgtccttgtgatagtttgctgagaatgatggtttccagcttcatccatgtccctgcaaaggacatgaactcatcattttttgtggctgcatagtattccatggtgtatatgtgccaccttttcttaatccagtctatcattgttggacatttgggttggttccaagtctttgctgttgcgaatagtgctgcagtaaacatacgtgtgcatgtgtctttatagcagcatgatttataatcctttgggtatatacccagtaatgggatggctgggtcaaatggtatttctagttctagatccctgaggaattgccacactgacttccacaatggttgaactagtttacagtcccaccaacagtgtaaaagtgttcctatttctccacatcctctccagcacctgttgtttcctgactttttaagatcgccattctaactggtgtgagatggtatctcattgtggttttgatttgcatttctctgatggccagtgatgatgagcatttcttcatgtgttttttggctgcataaatgtcttctttcgagaagtgtctgttcatatccttcactcactttttgatggggttgtttgtttttttcttgtaaatttgagttcattgaaaaattagaatttttttttttttcccttttttagaggcaaggtctcactctgtcgcccacactggagtgcagtagtgtaagcatagctcactgtaaccttgaactcctgggctcaagcaattctgtcatctcagccagctgaagtagtaactgtaggttcacaccaccatgcctatttttgtttttgtagaaatagggccttgctttgttgccaaggctggtcttgaactcctgacctcaagcagtcctcctgtctcagcctcccaaagtgctgggattataggtgtgagccactgcacccagccttggagatttttaataaagaagcttgtcaattaaacaaacaacaaaaagccctgagactgaatgagataatcaagagagtatgtgtagatagagaagaggtccaaggaaggagtcttgggtgactctgatgtcaagtgaggacatgaggcagaaacagcagtgactgagaaggagccacctagtaagaaaggaggaacaccaggacagtgtggtattctggattccaaacaaggaagttactgctaattttaaagctcttctcaggctgggcatggtggctcacacctgtagtcccagcacttcgggaggctgaggtaggtaaatcacttgagctcatgtgtttgagaccagcttgggcaacatggtgaaacctcatctctactaaaaatataagaaattaaggccaggtgtggtagttcatgcctgtaatcccagtgctttgggaggtcaaggcagccagatcatttgagatcaggagttcgagaccagcatggccagcatagtgaagccccatctctactaaaaatacaagaaaaaattaaccaagcatggtggcgcatacctgtaatcccagccactctggaggctgagacatgaaaattgcttgaacccgggaggcggaggttgcagtgagctgagatctcgccactgcacttcagcctgggtgacagagcaagactctgtctcaaaggaggttgcagtgagctgagatctcgccactgcacttcagcctgggtgacagagcaagactctgtctcaaaaaaaaaaaaaacaaaaaccaagaaaagaaaaaaaaactcttctaagaggatttttttttcctggattaaatcaagaaaatgggaattcaaagagatttggaaaaatgagtaacatgattatttactcatctttttggtatctaacagaaagaagatctggatattgtatgtgaaaggttcactactagtaaactgcagtcctttgaggatttagccagtatttctacctatggctttcgaggtgaggtaagctaaagattcaagaaatgtgtaaaatatcctcctgtgatgacattgtctgtcatttgttagtatgtatttctcaacatagataaataaggtttggtaccttttacttgttaaatgtatgcaaatctgagcaaacttaatgaactttaactttcaaagactgagaattgttcataaataaactattttacctgcagagacctctgatatatgtttcttgatggaagtacccagtaccacctatgaagttttcttgtcaaaaaatcaaatgtgaatctgatcattacttagatctaagtaccaatatatgaaaaatataggagacaaggaagcatggtaaatgatactgagattgggagactacatggaaaaagacttgttcccttcaacagatagacagcagggaaaaaagaatagagaaaggagtaaagaacctgtagattaaaagacatttaagggacatatgaaccaggtccagtgtatagatcttacctaaatcctgatggagcaaactataaaaaaatttttttgagacaaatgtttgaatacaggttgactatttgatggcattaaggagaaattatgaattatcttggtataagaatattgtcatgggtttttttttttgagtccttacctgttaagatacatactaaaatatttgtgggtaaaattatatgacgtataggagtatatgatttagaaaacggattaaaatataaaaggataaaataggatcttatattttgtgactcacttcctgttggatatctttctacccagtaaatatagtcctatctaggttttaatggctacatgtatgtactgtagtttgtttaaatggtttcctattgaacatttatgctctttgccattttttcctgtttaacgttctgtttttttttttgtttttttttttttttgagacagtcttgctctgttatccagactggagtgcagtgacatgatctcagctcactgcaacctctgccttctgggttcaagctattctcctgcctcagcctcctgaatagctgtgattacaggcgtgcaccactatgcccagctaatttttgtattttgggtagagacagggtttggccatgttggccaggctggtcttgaactcctgaccttgaatgatctgcccgccttggccttgcaaagtgctggggttacaggcatgagccaccacgtctggccttgtttaaggtcctgatgagtattcttataggtacactgtgtttcgtttaattatttccttaggataaatttatagaaataacattccttggtaaaagaatacatattttaaaaactgtattagtttcctgttgctgtcaaaaaatttccagaaacttagtggcattaaacaatacaaattaattattctacagttctggagatcagaagatacgggtcttactaggcctcactaggctaaaatcaaggttttggcagggctgtgttcctctatggaggttccaagggaccagagaaactactttacagtagttattttaagggaatgaaagtgaagatggggttgggcagtcaaagaggctgttacttttcatttttggcctttcagtagtttgaatttttttatcatatacatgtattactttaatttttaaaaagtaaaaagcagctgtgattcagtctctgtaatttagatcaatttacatcaaactagggtggtctcatgtgttgtcttgctcacagtgaccactagattattccaagaagggacaatttccaagacttggtttacactgagacggctcctgattttaaggataccttagatcaaactctaggaaggcagtttcattttggccttgcagttccctgggtcattttccaagcccatggcctcctggagtcttcgcctagctgtaggttatctttgtggctattatttcactgtaattatacaggaagatttattgagggatttctgtgtaccagccgtggttctcagcactttgtatactttgtattaactctgactcctgacagtaactctacagaggttctgctgttacccagttttacatagaaacatggccagcggacgcagttagaaaatggcaaagtggggattagaaactaggcagtttgactccagagtctgtgcccctgtccacttggctccactgctggggaagaggcctctgaagcagcaggaccatctgctgtgccgtgtgtagtggtactctatcttcctggtgtgatgttgtgttctactttgcattttcatgtctttccttatacaggtctcaaaatcatttacttttttttttttttttttgagacggagtctcactctgttgcccaggctagagtgtagtggcatagtctcactcactgcaacctccgcctccgaggttcaagtaattctcctgcctcagcctcccaagtagctcggattacaggcacatgccaccacagctagcaaatttttgtatttttagtagagattggtgtttcaccatgttggccaggctgttcttgaactcctgacctcaggtgatccacccacctaggcctcccaaagtgctgggattacaggcgtgagccaccccacccagccttatattttttaatgatgcacattagctcaattacataaaccagggaaatccagctaggacctggtgatttctgagcctgacccatgtgactttcaatgaactgaacttgccacagctgtatttactgtctactgagatgctgtcacacagaccccgtcatagcacagttcctgagttacatctttacatactgtagtatccttcttgtgaaaaaagatacagattccaaaggtctgagaaaccaatcttggttataaaggggaaaaatggtcatgggtttttaaaatttgttttgtcttaattgcatttcaaatttacatttctaaatgaataattgcttatataaagcagttttgattaacaatataaaacactatctatttggagtgattcctttacccatttctgaaggcaagttttaaaaattactagaagacacttcattgagaatattattaaacatgcctatagttctaccacctcaacacaattgcttattaacacattaatgttttggtgtgttttggactttttaatatgtatttttcacttgttctagtaattatgctacagattgatcatttctttttcaacatgtcatcaaagcaagtgagcaaagtgctcatcgttgccacatattaatacaaaatggaagcagcagttcagataacctttccctttggtgaggtgacagtgggtgacccagcagtgagtttttctttcagtctattttcttttcttccttaggctttggccagcataagccatgtggctcatgttactattacaacgaaaacagctgatggaaagtgtgcatacaggtatagtgctgacttcttttactcatatatattcattctgaaatgtattttttgcctaggtctcagagtaatcctgtctcaacaccagtgttatcttttttggcagagatcttgagtacgttttcttttctccttattgataaattgataatcctcaaggatgattattaggtgatactcttacttcatggattcttaaaagatatgatttaacatattacaagtgcctagcaaggtgtctgttacacgtaggtattttaagtaaatggtagctgctgatgtaatttctgcccctttgcccttcagttggggtattgctttggaccgattagagggctgtggctgggatgctaaaggttcatgtttccttagctggctcctgagccaccagctcccaccacctgtgtatacctgtgctagtttgccttcccacaagtagctgctggctatctgttatgctggtacagttttcagaaactgatgaatggcctttgaacagaacaaaaatgagattcagaataacaaaattgcacctttgtttttataagcactggccattcactagttgaagactggtaggaatacctaattcatgccaaaagaaagataatttttaaaaatcacacaggttgtttgtagattaaaagggaaaataggctaggtatagtggctttgcctgtgagtttgggaggctgaagtgggaggattgcttgaagtcaggagtttgagaccagcctgggaaacagagcaagaccccgtctctacagaaaatttttaaaaaattagctgggcatggtgatgcatatctgtagtcttagctactccggaggtgggaagattgcttgagcccagcagtttgaggctgcagtgagctgtgattacaccactgtactccaaccttaaaataaataaataaataagggaaaatatcttcaacaaaggatagttctgtctgtttctcagtcttcctcaacagataaatgtgtgaagtaatggaaggtggagatttcagattacacaacattaatgctaagggcgtttgactctgtgtgaattctaattgccctagatctagacgggctgatactattagaatcccctgtcactaactgaagacagagttgtaagttaatgccttcctagatagcctagattgtggtatgctgctgcatgctaaaatggctccccttccatagcaggatgaaatagagtcattatcttggcaaccagcccctgccaatgtgctctcagtctgcctttccagccccttctctctacctattcccagctgccatgtattctaaagcctctatgctttcatttttgtttttgccttcctggatggtctttcctgctgtctccacctgaaactattcctctctaaagaacagatgaattgccatctctctgggatgcttttacccaccctcactcccacctcaggctgaatggacccttctctagatcgcttagcatattgttctacagttaggtaaaaagtctacctatcactagatcaagagctttgtttttttttattaatttaattttcttttttttttttcttttttttttgagacagagtctcgctctgtcgcccaggctggagtgcagtgcacaatcttggctcactgcaagctccgcctcccaggttcacaccattctcctgcctcagcctcccgagtagccgggactacaggcgcccaccaccacgcccagctaattttttgtatttttagtagagacggggtttcaccatgttagttagccaggatggtctcgatctcctgacctcgtgatccacccacctcggcctcccaaagcactgggattacaggcatgagccaccgcgccgagccccaagacctttctttattaccagggcttccacagacctgacacatggtagttcctcaataaataattgcagaattactgaaaaattttactgttaacttaggcagtggtaaaaccattgtttggtagctcagaactcagcaagtaaatagcaacatttgctggaagaacagatagtttttcaaatccaattcaaggactgggtatggtggctcatgcctgtaatcccagcactttgggaggccgaggcaggcgtatccaggagttcgagactagcctgaccaacatggtgaaactccgtctctactaaaaatacaaaattagccaggtgtggtggtgggcacctgtaatctcagctacttgggaggctgaggcaggagaatcgcttgaacctggtaggcggaggttgtagtgagctgagattgtgccattgctctccagcctgggaaacaagagcaaaactccgtctcaaaaaaaaaaaaaatccaattcaaatgattatggaagtagtggagaaataaacaggaaaatgataaataattaagataatatataatatggctatattttaatctattgttgatatgattttctcttttccccttgggattagtatctatctctctactggatattaatttgttatattttctcattagagcaagttactcagatggaaaactgaaagcccctcctaaaccatgtgctggcaatcaagggacccagatcacggtaagaatggtacatgggagagtaaattgttgaagctttgtttgtataaatattggaataaaaaataaaattgcttctaagttttcagggtaataataaaatgaatttgcactagttaatggaggtcccaagatatcctctaagcaagataaatgactattggcttttgtggcatggcagcctgccacgtccttgtcttttttaagggctaggagattctttattgggatggcaaaagtcaatggcagggtagttgtcattgaaagaagattaagcttgaccccagaaggcatgggttagagcccagccttgtcactcaatggttgtatgtccagaggcaagtcacttaacatcccttaaccccagttttctcatctgtcaaatgaagcaaagaatacttgccctcttgacttaaagggtgtctgatgagacatatgactgtatcattagctgggagaaagtccatcgtgctgcctatgtatagtgcctcaagttggtctctttcccttctatgattacacaaagcactccgctgtcatgttatccatcccgcccctccattccaagtcccatctagagcacatcttcttgaagtccactgtaacctgcctaatcctggatgtgacgagccaggcaggaggcagaaaagaatgtgtgttttgcaatacatgttaagagacatcttgggctgggcacggtggctcacacctgtaatctcagcactttgggaggctgaggagggcggatcatctgaggttgggagttcgagaccagcctgaccaacatggagaaaccccatctctactaaaaatacaaaattagccaggcgtgatggcgcatgcctgtaatcccagctactcaggaaggctgaggcaggagaattgcttgaacccgggaggcagaggttgtggtgagttgagatcatgccactgcactccagcctgggcaacaagagtgaaacagggtctcaaaaacaaaaacaaacaaacaaaaaaaatcttttaccacggtgaccaccatgtgatttccaagaacttcaaatgatctaagaaattttgtgattattactagtttgaaaaatactttttttttttttgagacaaagtctcactctgttgcccaggctgaagtgcagtggtgtgatctcagctcactgcaatcactacctcttgagttcaagcagttgtcctgcctcagcctcttgagtacctgggattacaggcatgcgtcaccatgcccggctaatttttgtatttttagtagagacagggtttcaccatgttggccaggctggtctcgaactcctgacctcaggtgacccacccaccttggcctcccaaagttctgggattacagacgtgagccactgcacccagcctgaaaaatatctttgaatgccatgtgatactatacttgtcagtttacatgtgtgtcccactaaatcatgtactctcctgagcaggatcatgctttgtcttcatattttctgtacaaagcaaagactctgacacaaagctagcccccagtgcatagttgagaaatcagtgaatgaatgtgggaggcaggaaaaatgtcctttaattcttctgttaatgctgtcttatccctggccccagtcagtgcttagaactgtgctgttggtaaatataattggattcactatcttaagacctcgcttttgccaggacatcttgggttttattttcaagtacttctatgaatttacaagaaaaatcaatcttctgttcaggtggaggaccttttttacaacatagccacgaggagaaaagctttaaaaaatccaagtgaagaatatgggaaaattttggaagttgttggcaggtacagtccaaaatctgggagtgggtctctgagatttgtcatcaaagtaatgtgttctagtgctcatacattgaacagttgctgagctagatggtgaaaagtaaaactagcttacagatagtttctggtcaaggtttagccaccaattttgcagtttctctcatctccccaggaaagagcagttggtctttagatcaatgagagctcttttatggcagacaaaacaaagtgactctagccaacttgagctaaaaagaaatttagtggaaggctaggagttaccacatgaagtgtgtgcagctgccccttggagagaataagaaccagggtgcctctgggacttaacatcattactgtactccagttgttttcattcttttcctgactttgctctagagtcagtttcctaacagagtacattcgatgatcatgtgcccatatctgtggggagaagatttcttgattggcagtcttactaagggtgcatatcaagtagaatggaatagaggtagtttcctaaaggaagatgagaggctgttaccaggaggaggagaagggattcaggacagatgaaaacaacgttatatccatgatagacttacgctgctggtacagatggtacaggtggcttcagtataggctctccgaacccacatatcattgattatgatagggatatgttaactatttttcagtgtatatatgtatatgtgtgtgtgtatatatatgtatatgtatatatatatgtatgtgtatatatgtatatgtatatatttatatatgtatatgtatatatttatatatgtatatgtatatatttatatatgtatatgtatatatatttatatatgtatatgtgtgtatatatatatttatatatatgtatatgtgtgtatatatatatatttttttttgaaacggaatttcgctcttgttgcccaggctggagtgcaatggtgcgatctcagctcactgcaacctctgcctcctgggttcaagcgattctcctgtctcagcctcccgagtagctgggattacaggcacttgccaccatgcccggcaattttttttttgtttttttttagtagagagggggtttaatcattttggccaggctggtcttgaactcctgacctcaggtgatctgcctgccttggcctcctaaagtgctgggattacaggcgtgagccaccatgcctggccatttttcagtatttcttttttttttttttttttttttttttttgagacagagtttcactcttgttgcacaggctggagtacaatggtgtgatctcggctcaccgcaacctctacttcccaggttcaagcaattcgcctgcctcagccttctcaagtagctgggattacaggcatatgccaccatgcccggctaattttgtgtttttagtagagatggggtttctccatgttggtcaggctagtctcaaactcccgacctcagatgatcctcccgccttggcctcccagagtgctgggattactggcatgagccagcgctcctggcccatttttcagtatttctaaaaaaaatctaaagtgggtcaaacatttcaccttaatagaatgacaggtttgtacatcaagtttctttgctttttcttggaattttatactttttttttttttttggagacagagtcttgctgtgttacccaggctggagtgcagtggtgcgatctcagctcaccacaacctccacctccaggttgaagcaattctcctacctcagcctcctgagtagctgggattacaggcacatgccaccacacccggctaattttttttttttttttgtatttttagtagagacagggtttcaccatgttgtccaggctggtctcgaactcctgacctcaggtgatccgcccatctcggcccaccaaagtgctgggattacaggcgtgagccactgcacccggcctttttcttggaattttatcaatcagtgtcagaatattcattacctcctaaaaataaaggagttctagttggctgttttgattctaggtgtggtaaagtgaaatattgttacttaataaatgcattttgctagacacaatccttcggttcacgagctctgtagagaaaagagaaataaccgccaaccaagaaaagattgggagatactagaataagacccaggggcaggaagaagccagtgagaaggagggcatgttgagagctctgagagagaataaaagcaggggttgttggagctagcttctcaagatgtccttgaggcaaaccagacctttgggacactctgaaaataaaactgaaagtgaagagattgtgggccgaatgtggtggctcacgcctgtaatcccagcactttgggaggtcgaggcgggtggatcacctgagatcaggagttcgataccagcctggccaacatggcgaaacgccatctctactaaaaatacaaaaaaaattagctgggcctggtggcaggcgcctataatcccagctactcgggaggctgaggcgggagaatcgcttgagtccaggaggcggaggttgcagtgagctgagatcgtgccattgcactccagcctgggcaacaagagcaaaactctgtctcaaaaataaataaaaataaataaaaaagagatagtggcgtgatatccttgattctatcagcaacctataaaagtagagaggagtctgtgttttgattcagtcacctttagcatttttatttccatgaagtttctgctggtttatttttctgtgggtaaaatattaataggctgtatggagatatttttctttatatgtacctttgtttagattactcaactccactaatttatttaactaaaagggggctctgacatctagtgtgtgtttttggcaactcttttcttactcttttgtttttcttttccaggtattcagtacacaatgcaggcattagtttctcagttaaaaaagtaagttcttggtttatgggggatggttttgttttatgaaaagaaaaaaggggatttttaatagtttgctggtggagataaggttatgatgtttcagtctcagccatgagacaataaatccttgtgtcttctgctgtttgtttatcagcaaggagagacagtagctgatgttaggacactacccaatgcctcaaccgtggacaatattcgctccatctttggaaatgctgttagtcggtatgtcgataacctatataaaaaaatcttttacatttattatcttggtttatcattccatcacattattttggaacctttcaagatattatgtgtgttaagagtttgctttagtcaaatacacaggcttgttttatgcttcagatttgttaatggagttcttatttcacgtaatcaacactttctaggtgtatgtaatctcctagattctgtggcgtgaatcatgtgttctttcaaggtcttagtcttgaaaatatttatagtgtagtagaactattttatcctccaatgctccttcttttccttgtatttccattatcatcactttaggatttcacttatttatcattcaacatttattaattgcctctcatattccaggctttgtgctagaagttagggatataaagacaaataagatatttcctgcccttaaagactagattcgtgttgctaagtcttcattatcaagaaaagcataagtggggaaaagtgcttgcattatggattcctcatagttgctcccctctgcatgtaaaaatcaccatttccatcatagattcctagcggtctcaggactttataaagcccaaagtgcctatgtcataatatgaggaaaaatactgagacccttccatatatgggaggtatatggatgagacagctcctgacttcacttttcccagaaatctgaaaagcagcagcagtcattccagagcccagtttctactttgaagggcagattatttattctttgagctaacctgactgaggaacaattagtttgcttttaatttactattttctttttcttttcttttcttttttgagacagagtctcactctgttgcctaggctggagtgcagtggctcaaacttggctcactgcaagctccgcctcccgggttcacgccattctcctgcctcagcctcccgagtagctgggactacaggcgcctgtcaccacacccagctaattttttgtattttttagtagagacggggtttcatcgtgttagccaggatgatctcgatctccagacctcgtgatccacccacctcggcctcccaaagtgctgggattacaggcgtgagccaccgtgcccagccactattttctttctaattgttaatgaattaattttttaaaactgtgctcctagagcgaagggagagctctgtttacagtgtaacttttcagagcttctttaactagattttaagatcagaattagttgttgtgaaatcttagggactgtacaagattagaaatcctctatagcagcatttcccaaagcaggcttccagaacactagcctcatgaggcattttgggaaaaaagagtttgctggttcagtgtgtatgggcagtgccacaagccgtaccctccgttgaagacactcattccacacattactgcataaaaagcttccaccagccattcggcaaacttattgagtgtctgctatttcctgggtattgtgctatatggtagggttatagtagtgaacaaagaagaaatgatgcctgctctcagctgactttgcagttggaaagacacatgaaataattacgccattcattagcagattgtgctagatgcctcactggaaaaataaaggacatgatggaaaactctgtagggtcagagaaagggatcattagagaaggttctttgaagaaatattttttgaaatatgaaggataaataggaattaactaggtaccaataggttaggagtagagctttccagacagagggactagttcttgggaaggtctccagacagaaataagtgtggcttgtctgaggacctcttattcgcctattaaccttccctccccagtaaacactcctgggaacaacacacattgtagaaccacgttgtggtgctgttcagtatagcaagtaattcagcagagataagttcttggaatctcatctttgggatttagttactaagatacattcaagtttgagcaaaataaggtctcagagcttggattcattgttctgttccagcaattagagcagtacctggcacatagcacaagtgcttgaaaacactgactgagtagggtaggtgggtgagtgggtgggtgggtgggtgggtggatggatggatgggaggatgggtgggtgaatgggtgaacagacaaatggatggatgaatggacaggcacaggaggacctcaaatggaccaagtcttcggggccctcatttcacaaagttagtttatgggaaggaaccttgtgtttttaaattctgattcttttgtaatgtttgagttttgagtattttcaaaagcttcagaatctcttttctaatagagaactgatagaaattggatgtgaggataaaaccctagccttcaaaatgaatggttacatatccaatgcaaactactcagtgaagaagtgcatcttcttactcttcatcaaccgtaagttaaaaagaaccacatgggaaatccactcacaggaaacacccacagggaattttatgggaccatggaaaaatttctgatccataggtttgattaaacatggagaaacctcatggcaaagtttggttttattgggaagcatgtataatttttgtcctaagtctgtgctcagccctcccacatgtgctcattgctggttgactgttggagtctggttcttacctctaagaggaagcccaggagagggcataaagccagcacactgtcctcacctgatggtgtcagagtccttacgagtaagccctagccagaacattgctggaagagatcaagggccactgtttgaaattgcacagcaggatacggaaaaggggtaccttaggtataggcattgtcattaaagaaattgctaagatacttgagattttcctgtttaaggaatgagctttatgatacaaagagcagttctaaaaattagggagggaattaactaaattaattaggatatttctcaaattcctttacagtttttgtctctctgctgatatagtgtttacatgattgttatttactaaacaaatgctattttgtattgtgctccttataacttaattgtttattacaaggttttgatggtgacctaccaacaacaagtaatcccaaacacagtctgaattttttgttttccatccagaaataagatgaatctttccatttccgtgttttcagttttcatcatttttatcctataggttacttatctttattttaaagcatttcataataattttatagtttttgttttgtttgcttgtttgctgttggaaatggaatattccctccttccatttagactgctaaccagctgtaaatgtttcaaaatatgcatgttttacagcagttgttcaaagcaatacaggaacagtaaggacagagccagtcattttacaaccacattctgttaaactgatgtctattagcagggtttttcctattttattaggaaggacttacacctgatatataacaaagcttgttttaatcaaggctcagaaaatgtttttcattagtttttttcctaaccatgaagaataactgctttgtaacacacatgctggctataaagcagacaaaaaattcactgtaggtgctgcctgactggcctctgtccgtgtttctgttggggctgcttaccacagcctctgcattatcattagctagtgtgttcacaataccaagttcccagtagcaaagaaaggtcaagctcttacgcatgccattcatttatctacactgtgcaggcgcactcaggtggcagggacaaagaccactcctttggcgcatctcaagttcagaattctcagtagaggggctccagctgtccttttgtcaggtgcccatgcctgctccaggcctgtgtggtcaggacacgtgttacagagtacagtgacattaatgatggggccatggatatggtcagcactcagaggatgttagtctcttcattgataaagtcacaaccacttttcctgttggaaataaaaagatttgacgtatccttgtctacagcaacacaggacaacagataatcagcaggtcatctaaatctgttcagagagaaaggagagctgtttcctgaaaatacatcttcccctgattttagtcttatttttttctgcctttattgctttctaccctcttcaaaccagcctcatttcctaaattaccttgaatatgcattgacacttgtactgcctgaaattctggaaaactcagtatggctactccaccgtcagaacttcctgagcaaagttagttgctctctcggctcactgttttgttttgttttgttttcctgcctcaggtttatttgtacaaatagcacaggaggaccagccccatgcagatggtagcccaggggcgggggtagggggtcacaccagtccttctgtcctcatgttggcagagatatctactctgaagcctttgtaggggcctgggcacctttgggagcctgagctggaactgaaggtggagctgcagcctgggccttggtttgatccttggccttggcctttggccggcacagcctgagccccttggcaatacgggcacgagcacgcttcccaagcttgggatgggcaatgtaggcaagtcgatcgagcttgcggctgacaccctttgggatcttgggcttaacctccttgggctttacgagggccttgatagcctcggcacgtgcactcatggccttggcattgttggcctgcatcttctttaggcccttcttgttgtgcttcttggcaaagtgcatgttcctcaggaacttggggtccacccccttaagagattcgtatctttgtgatcggggtttcttgataccatttctgtgccattttcgggactggttgtgtgtggtgtggttcttggacttcgccatgtctacaccttaagccgcggctcccgaagcacctagaaccggaagagttggctcactatttagcacacacacacgtctataatagtgctggccacttggggttggaattagtttatttatcagcatgttgtctcccagcacttggtgtgtgtgatatgcagtatgtatttgcagaatgaaaagtctgagggctgacatcatatttcccactgtgcccagaaagagcacagttagtccacatgagctaatgggggcaaagggaagtgaggagggagaatgtactgccttatcatgttttctattacttggctgaagtaaaacagtcccaagccgatagtaagatagtgggctggaaagtggcgacaggtaaaggtgcacctttcttcctggggatgtgatgtgcatatcactacagaaatgtctttcctgaggtgatttcatgactttgtgtgaatgtacacctgtgacctcacccctcaggacagttttgaactggttgctttctttttattgtttagatcgtctggtagaatcaacttccttgagaaaagccatagaaacagtgtatgcagcctatttgcccaaaaacacacacccattcctgtacctcaggtaatgtagcaccaaactcctcaaccaagactcacaaggaacagatgttctatcaggctctcctctttgaaagagatgagcatgctaatagtacaatcagagtgaatcccatacaccactggcaaaaggatgttctgtcccttcttacaggtacaaggcacagttttccttcatttattcactaatttagcagaacctcactaagagcctcctatatgccaggctctgcgttagcaataaaaggaatgccatgcctcaccccatcaggaggtgctgatagcttgtaggcggagtggaaacagatgtgctctagaggctctaaatattacttctgctggggtcagttgggaagccacaacagctactgttcatcttccataaaagacaatcagccgggcacagtggctcacacctgtaaatcccagcactttgggaggctgaggtgggtggatcacaaggtcaggtgtttgagaccagcctggccaacgtggcgaaaccctgtctctactaaaaatacaaaaattagccaggcatggtggcgggcgcctgtagtcccagctactcgggaggctgaggcaggagaatcgcttgaacctaggaggtggaggttgcagtgagctgagactgtaccactgcactccagcctgggcgacagagcgagactccatctcaaaaaaaaaaaaaaaaagactgggttctgttctgtggaggttcttgtcttaacatatccactgttgattgcccagatgttgatgtaattaatttagcagtcgtaaatagtttagcacttgcattaaatagaccaaaccccatagtaggtatttgaaatacagaataaatgtgaggtacccctgctctaaaggagtttatagtccagagctgacttatggaggatttctttctattatttctgggtctgctactaatttgtctatttcatatcctaattatccttgttttcattttgattgaaagggggagagcatagaaattgtggtaaaaggtagttttattttttatttgagatggagtcttgctctgtcacccaggctggagtgcagtggcacaatctcatctcattgcaacctccacctcccgcgttcaagcaattctcctgcctcagcctcccgagtagctgggattacaggtgtgcaccaccacgcccagctaatttttgtatttttagtagagatggattttaccatgttggccagtctggtcttgaactcccgacctcaggtgatcctctcactttggcctcccaaagtgttaggattacaggcctcagccactgcacccagcctaaagttagttttagattaagtgttttcatgttttcccttgcaaagtaataaactggtcaagttatcaccttgttccatctccatattaatcagggtccaaacaggagatagaaaccatgcaacaatttgagtagttgaataaagaattataaacaggagattagagtaataggggattagatagtaagaggtgaagagataggaacagcagatataaagaacaaccatttcctcctatggctgagataccatcccctcaccacactcccccacctactcactgagatgcagaccttattgaagagaatgtaactggcttgctgcgaggtaaagtcaatgaggcgctccccagtaccactctgaggggatgctggggaaaactgcccatgagaagagggcacatgctgctggccacttgtgctaaagaacttgaagtctgataggagtgcaccctaacctggcatagaaaccctttcttcctgctgagtccctctagcaccttatactggcaaagctttacattgcaaacctccattatcacagagcaagcaatgaaagatggactcagagctgaggcgataaattgatagctagcatagcctctaaactgacttttatgactacattttatggatagaaagtgttcttatatatattgtttctttacataataggggacttattcatggctgcagatgagaaaacagatcctaagaagttaagtgacttgcccaaggtcacacaaagaattccactagttctaaaatgacagtaattacagttaacatacattgtatgtggcagatacatataaagcacatggcattaatttttttttttgagatggagtcttgctctgtcgccaagctggagtgcagtggcacgatctcggcttactgcaacctctgactccctggttgaagggattctcctccctcagcctcccgagtacctgggattacaggcatgcgccaccacgcccagctaatttttgtatttttagtagagacgtggtttcatcatgttggccaggatggtctcgatctcctgaccttgtgatccacccgcctcggcctccccaaatgctgggattacaggcgtgagccaccacgcccggccacttggcatgaatttaattcccgccataaacctgtgagataggtaattctgttatatccactttacaaatgaagagactgaggcaaagaaagatgatgtaacttacgcaaagctacacagctcttaagtagcagtgccaatatttgaacacactcagactcgatcctgaggttttgaccactgtgtcatctggcctcaaatcttctggccaccacatacaccatatgtgggctttttctccccctcccactatctaaggtaattgttctctcttattttcctgacagtttagaaatcagtccccagaatgtggatgttaatgtgcaccccacaaagcatgaagttcacttcctgcacgaggagagcatcctggagcgggtgcagcagcacatcgagagcaagctcctgggctccaattcctccaggatgtacttcacccaggtcagggcgcttctcatccagctacttctctggggcctttgaaatgtgcccggccagacgtgagagcccagatttttgcctgttatttaggaactttctttgcaagtattacctggatagttttaacattttcttctttgaacctagttataaaggtattgtgctgttgttcctaggcttagagtcataaggcctgagctcacttcctcactttgcctccatctggaaccttagaccaacttcctaggaaaacgagctgtctgaaaacagaatagggtgcctcttcaatgtgctcttcactggagatgttcaggaggaggctactcccacctacacagggtgcagtggagggtctgggccccagggaggcagcaggaagagtggaaagagcggaggctctactgttggacagacctgggttaccagccgtgtgactagccttccctggcctccatatccccctcagtaatgaaggaatgtgtcatccccaaatccagggacagttacaagcagtcagtgaacagaaagtgtctggtacaggttctaagtgcttattattctaagtcacttcacttacctgagttctcagttttcctatctataagataagcaggttggataaaatgttctccaatatactcctggtcctgagatgatgtgattgtgggcagccctttaatcatggtgaagatgttcatcataagcacactgaaactacaaaataggaatataaatattttctccattaaattatgctggatcctagaagcaaaaactggaactgtgaaaccctacttcacagaaaacttaaaattcccaagcagatgaatgcttctcggaaggacactgacagttacctacctggaaagaatctagatggaggtggcatgggcactaagcggtgagattaaacccagttagggcagccccaccagccttggaacccacacatctggagattgttgatgcagagagaaaggttcctactggtgagacctgaaagggatatgtggcaggtgggaggaagaagttctgtctggaaaccaacccttgttcctccgttattgattgactcctggtaccaacatgagccctaggtcttatagaggccataagtccctatgccttatagtgcccatggatgagatgaggccacacatgcccccagtgggttaacatgtctagcgtgggtaaggctcttggagcactatgatacacaggaaatgcccagtaactcttagttggtttgatatctgttcccattgctcacttaagctcagtgcccctttactgatccttttattctgcctccctctgcacatgtgcattgagactcctatctgagacacacactgtgttgggtgcccagggatgcagcatagatgttgctgccttccacagaagcgctcatggtctgctagagaatatatcccatgggagagaaaaacagactcgggagaatatagcaggggcccttgtcctggactttggcagttaggaaagggagggaagagacatggaggctgggacccaaaggctaaataggaatttgctgggccaaaggggagggggaatgaaaagagtgtttctggcagaggaaatggcaaggataaaggcctggaggcgcaagagaatatgtgtttgaggatctgaaagttgagtgcagtgggtccagtgttctctaccctggctgccattagaattacctgggaaacttttagaaaattccagtgtctgggccctccctaaaacaataaatcattcttgggtggtggggtctgggcatcaggattgtttaaaaccctccccaggtactgtcatgtgcagctggggttaagctgtgctggggtctgagtatggatctgttagggcaagtggcggtgatggagttgaggctgcagaattcaggccaaatagagaggttttcatcaggatattaaagagtttagatttcaatttggtgggaatggatgggatcttatttgcattttatgaagagctccctggttgcaatatcagaatggattggagaggagcaagatggaagcctacagtgatttgggagaagtggtgagggacttgagacacaggaagtagccccattcactaatagttgagtatgtagatttgctaggacctggaaatggtttggctggtggggagtgggaagaaaggcccaaagtgtgaaatgaagatggagagcacattgcctagcccagagtgattgccatttgctctgtcccagttgaggtccaaggggttggccagagatcatggagtctgtggctccatggggagaagaacctctcagcatgcctccttgtcttatcctgggttagtcagattcattttgttagattacattttttttccagtggaactctgcttaagtcctgaccagtatgttttcagaaggatcagagggcctgcccttgtccattggtgcatgacaccagcttggtgggttccttgctgctccctgttttcatagggttatcagaataccttctctccctgccaccagcaggtcacactggctcctgactttttggcccatggaaccaccatctttctgcttcttagattgtgccttgtactccactgatcatggccagtacatcagaagccctggtttgcagtgaatgcatttgatatggaaatcaggaaccctggggataccactcatcatatttggttgctgtgtttttcctccaatctttcaccataacaacaatcaactcaaaagatttctataaccacttgtgtgggggtttctccccacacactaaacaagcagtcagttccagagtggacagcagctggtctcctccaatttaattccaacactgtctacttggagatagcattagatcccacaggttgagggtgcagtcccctagactgcccccagtctcctgcttcagacaccagtcacaagtccaggactctagaagttctgaccagtttcaagttggggttcccacaaccccccactttatttttgattaatttgctggagtggctcatagaactcagggaaacacttagttttctggacttattacaaagatttaaaaagataccaataaatagccaaataaagagatatacagggctagatctggaagggtctggagcgcaggagcttctgtccccatctacttggctcccagcagatggatgagttcttattcattttcttgtcagcttcgacatgttcagctctctggaagcccgcaaactcttgtcttcttgggccttttatggagacgtcgttaggcaggcatgattgaaacatggacaactgtgtcgaaatatgattggacataaaggggtctaaactcagtgaggcctgtttgttcagattcttcttggcctctctgtggccattctttcctccaggatatggggcaggacccctatggaatgagggtcttatgacccacaatcaaattagagtcctgccttgggcaagtgaaaggaaagcaggagaaggtaagagaaattctgttgcctaagaccttctgaggcctaaagcaccccaacattataacagaagacgataacaggactatgggagttatgagctgggaaccttggacaaaaatatatacatattaaataaatattaagtgtatatatatacttacgtatattaagtgtatgtgtgtgtgtgtatatatatatttttttaatttactggttggttttgggaagcagaaattaccataactactcttaaaaatcttttaagtctctttgaagttagaaaagtcactgtacctttttgtttccattggccctgtacttcttattataccccagcaggaggagcataatgtgttgttatatcattctggtgataagattcataagtgggttcagctggtgacagcctgattccctcattgtaaacttatccatcaacatgtagcttaatcgtttcaccttttgtgatgaccattacctgaatcagttatttcattagattgcaagattatgcttttctgattttatcatttcttctgtattgactgtaattctttggtatagaagaactttcccttgttaatagctatttggttgtcctgaagtacagttcttactagaaagtaagaccaaatgctgaattatatccctctagctatcaattttcgaaggaatgaatggtgtcctagtaatttccagtggtgtttaattacgttttcccttctctttctccttctcttattccctccctctccatctcctccctcctcactttcagttttttgctctttcagtattttgtcatagctgttaacagagcaacatattttaatcaattgtagtcatttttctttttggtgctcaaattatcccgtcttagtcccatggaagcaagcccttggagctagggccctctaccttttgatggatttccatttgtcttgataatttccttgtttctgacaagacaagatgttgcaggcacattttatactttcccagcccaaaccctggaataggccttttctccgaggagctctagttcattttagtgggaaatggtatttagagactataatctgggatctgggagtcctcattgctactgagtagtcattacttttaggcttttccagtggtcagagctaggaaatatgtatatttaaaaatggacagttgaatggttgttgccaggagctgggaggaaggggaagtgagaaattgtttaatgggcacagagtttcagtttggggaagatgaaaaagttctagagatagctggtggtgatggttgcgcaacaatgtaaatgccactgagctctcatttaaaaatggttaaaatggtaaattttatatatattttaccacaataaaaaaaagtcttcttctgggagcacccccccaagacaaaaatatgaaaattttacactgatacttccatttcaagataattttaagattataaggattttgcttaattcttgaattttatacctgtaaaccttttatacttcaaatttcgggcagaattgcttctataacaatgataattatacctcatactagcttctttcttagtactgctccatttggggacctgtatatctatacttcttattctgagtctctccactatatatatatatatatatatatatttttttttttttttttttttaatacagactttgctaccaggacttgctggcccctctggggagatggttaaatccacaacaagtctgacctcgtcttctacttctggaagtagtgataaggtctatgcccaccagatggttcgtacagattcccgggaacagaagcttgatgcatttctgcagcctctgagcaaacccctgtccagtcagccccaggccattgtcacagaggataagacagatatttctagtggcagggctaggcagcaagatgaggagatgcttgaactcccagcccctgctgaagtggctgccaaaaatcagagcttggagggggatacaacaaaggggacttcagaaatgtcagagaagagaggacctacttccagcaaccccaggtatggccttttgggaaaagtacagcctacctcctttattctgtaataaaactgccttctaactttggcttttcatgaatcacttgcatcttctctctgcctgacttgccctctggaatggtgctggaatggtcctgtggccttgtccactgtctgcctttgaccataacttgaaagtcacccaccatagtgtcctttgaaataacttaaatgtccacagttccaagcatgagttaaaaacacttcagaatgtagagtagttgttcaattgaataaacacacacaccagaaaaaaaagcaagtttatcttttatttttagtaaagaattttgatagagcctcaacaccagaaatggctagagagagaagcctaacatatctggaggattatttttcatcctacttaaagctgctttcacttttttcaggaaaaaacacacgttctgaatctaatttataaaactccctggccgggtgctgtggctcacacctataatcccagcactttgggaggctgaggcaggtggatcacctgaaatcaagagttcaagaccagcctgaccaacatggtgaaaccccatctctactaaaaatacaaaattagccagacgtggtggcgcatgcctgtaatccccgctactcgggaggctgagacaggagaatgacttgaacccgggaggcggaggttgcagtgagccgagatcgcgccattgcactccagcctgggcaacaagagcgaaactccgtctcaaaacaaacgaacaaacaaaaaccccaaaaatccctgaagtacgtgagctagtggtgaaagaaagctggagaaaaggagcaggaataataataataataataataataataaagattgtcatttaattttgagtacttccagtgtacactttgcaggtactctaagacattacctcactgaaatctctaaggtagatattctttatttaaagtgtacttgtatgaaacctggagctcaaggtgaaggaatttgcccaaggctgcacttgcactatcgtggcactaattagccgtgtgaactgggacacgttacttcagtttgctcatttctgagtcagcctagcaagatgacttctaagaattttttccagccgggtacattggcctgtaatcccagcacttcgagaggccaaggtggaagggtcacttgagtctaggagttacacacaacacacacacacacacacacacacacactagccaggcatggtggcaaatgcctgtagtctcagctactccggaggctcaggtggaaggatcacttgagcccaggaggttggggctgcagtgagccatgatcacgccactgcactccagcctggctgacagagtgagatcctctgtctcaaaaaaagaaaaaaaaaaagatttttttccagggaataataaaggaagctaatatttatggagcatctacggtgtgccaaatactttgcatacgttatctcatttaatgctcttatccctgcagggaaagtattaacatttgtttatcacttgcagaactaagtgatatttaccacagagtagacaaatattttcaagcccaaaatcaagtggtatcacttttctgctgagaatgtttcagtggtttcctttgctcttgggataaaacttaaatccctcaccctacccttgctccaaccctccactttccttctcccatgtggtgatttggccatacagctcttgtggctgatctgaactgactgagctttttacccttttgctcttgctgttcttacagcctgggaaccccctggttacctcttggcttggtgtggtggcttacatctgtaatcccagcactctgggaggccaaggcggacggatcacctgaggttgggagtatgagaccagcaagtcacctcttgccagtggcctttgtccattgagtctgaagttctttctcctctcatttccccatcattctattatgctaccttgttttattttcttcattgtgtttattgatacttaaaatgatctcttttctgttgctgtttgactctcccactagaaagtaagcattgtagatcgggcactgtggctcacacctgtaatcccagcactttgtggggcagaggcgggtggatcacctgaggtcaggagttcgagaccagcctggccaacacggtgaaaccccatctctactaaaaatacaaaaaatagctgggtatggtggctcgtacctgtaatcccagctactcaggaggctgagacatgagactcacttgaacctgggaggcagaggctgcagtgagctgagatcacaccacagcactccagcctggaagacatagtgagactctctctcaaaaaaaaaaaaaaaaaaaaaggaagtaagcattgtgagggcaggtaccttctctgttttgttcattgctggatgtagttagtatacagcagtatctgatggatggatagatggaggaatgaatgaatgagacttcacaaattcagctcacttgctcaaggccctgcagctctacgggatgaagctatactccagagtcctgctacattggctgtgtggccagctgctgggatctgagggttgtcagataagcagtctaccagagaacagactgatcttgttggccttctgccagcacaggggttcattcacagctctgtagaaccagcacagagaagttgcttgctcctccaaaatgcaacccacaaaatttggctaagtttaaaaacaagaataataatgatctgcacttccttttcttcattgcagaaagagacatcgggaagattctgatgtggaaatggtggaagatgattcccgaaaggaaatgactgcagcttgtaccccccggagaaggatcattaacctcactagtgttttgagtctccaggaagaaattaatgagcagggacatgagggtacgtaaacgctgtggcctgcctgggatgcatagggcctcaactgccaaggttttggaaatggagaaagcagtcatgttgtcagagtggccactacagttttgctgggcaagctcctcttcctttactaacccacaatagcatcagcttaaagacaatttttgattgggagaaaagggagaaaaataatctctgtttattttaattagcattaattggtattcttgttaaaccataggagtcagagtaaatcagccatttcaccaattttcagtttgtttctgtcttagctaacagcagtgtaatggtcagcaaaattcttatcttgtgtactgaatggcatgtcctgttgctgaaagtgcacaggcttgggaggtagccatgagctcaaatcctggcactaccacctctcttgtgtgaccttagactcctgacctttctatgcctcagttctttcttacctataaaatgaaattaattttacccttaaagatcatcgtgctgattagagataaaatataaataataacacttgttacagagcaaggagttgacacttttatattctgaagacaaagtggtaaatcattatcatctatgtcagaaatagcttttgagaatacctgagtatagaactatcttgatccctgttacttcaaaactaaaataatggttttaggaattaaaaggtgaggctagtcacctccaagggatgaactgactcagggattgaggtatataacagtgaactggtccaaacaacagtcctgaccccactttatgagtgagactatgagtaatggtctaagtgtagacatcattgtccagggctccagtaggcagctctgtacttgagaatttagcagtgacccttctatttttcatctattatacctttttttttttttttttttgacacagggtctcactttgtcacccagctggagtgtggtggtgcaatcatggcccactgcagcctcaacctccctgggcttaggtgatcctcccacctcagcttcctgagtagctgtaattacaggcatgtgccatcatgcccagctaatttttcttttcttagaggtggggttttgccatgtttcccaggctggtcttgaactcctaggctctcacctctgtcttccaaagtgctgggattacaggtgtgagccaccacacctggcctattacacatttcttaattaaagtagtcaaatttgaaaactgttacaaagtgtatcttaaaatacgacgatctggtttaatttttaaaagatatgagtagccaaggagcaattctgtgcctttcccactagtccctaaccttttaaagcagctgcttcttggctgggctcagtggttcacccctgtaatcccagcactttgggaggccaaggcgggtggatcatgagtcgagatcatcctggctaacacagtgaaaccctgtctctactaaaaatagaaaaaaatagctgggcggggtggcggatgcctatagtcccagctactcgggaggctgaggcaggagaatggcatgaacacgggaggcagaggttgcagtgagtcgagattgtggcactgcactccagcctgggcgacagagcgagactccatctcaaaaggaaaaaaaaaaaaaaaacccatctgcttttgattcagtggcttctttaattttgtcggtctcagtcaccatttgtctaagcaaattcaggcaggcttcaccttgcctttctacatttgttcccttttcttagcattttgggcctttgtttacacgtgggaaaagacccacaggtcgtctctccctttgggcaggatacaggcttcctgtgactgaggttttgctagctgtagaagtggctgccaattggcttctggtttttatttccatgatttgctccagtggctcttcccttccatcattgttagctttcaagctaggaacttttaaaatgcttttaaataaaagtgagctgttacttgatgcatttagcagtcttcctcacagtggttttgatagacagactccctcagtttggaatttatgagttttctttaagggtttgtctccctcatgtatagcaggctgttgaaagttacaatgtcaataactttctgaatagtatcaaactgttttcagtgcagtgtattaacaaaactaacctgcctcaagtttggtcagctttggagtcttactgaggctaaaatgataaatctaaatgatttaaaattgtgtattcctacacagtatctcacttaattatgtaatagtcttgtgagtgaggcagagcagatgccgttttctctattttaaagatgaggaaaatggaatggaaaatggaaaggacagactaattgcaacatcctcgcaatcaaaaacaggcccaggttcatgccttgttggcagtgggttgctactggctgtggccttcatgcaggaaggctagatgcataaccaggtcaacagcccgtgcaggacaagcacgccatgtaattctgattccatcgactgaggctggtgttttcaaacgtgctggtgtagggtcttacagacagagtcatctgtgctatggggaatggaatgtgctcttgctttggagccagaactcctctgaagctcccaccacctacaccattcagaggccagacagaaatttgttcaccattttgggcatgattttcgtgcttttgtaaaatgtgcttcactgcagcccttactgggctgtggtgatgaacacttaagatactgtgtgtgtgctttataatctgtaaggcactgttcaaggggagggacctctgccatgagcccctacccactggtatctggttgacatccaaagccccagcctgggagaagctgattctctagttgaatgctgtatagggatttgactgaggctcagatttggtgaggaagaccactaaccttaacagaccaacaggctggctactccctgatgaagttccccaggccatgaaagaagtaagagatacattccttgtaacagctttcttagttgcacctgtatgattatttgatcagtgtgttgtctgtgcagggatcatgtctgtggagctcaccacctcgtcctcggtgctgagcagagtgcctggcatgtgtactcagtagatatttgctaagggagcgagtcagtgattgagaggagcagcctgggaggtaaagccctagaatctttattttaaagggatatcaaagttgaacattcagttagacagttctcttgagtccagggatttacccatccatggtggacacactttcagttaaaaagtaaggttaattttgacaggttgcagtatccaggcaagcattctatggaataaggctcatctcagggattagtaatgactgaattaacttactgctagtcccataattttgacgttaattaatggggttaagaaatgtcataagctatttggtaccatttaaagtgaaaatacccttaacgttttttgcctccagatatccacacttaatttcattttcttgctctttggtgaacagtcctgggtctgaatgtatatatccatggtttgtcactaggtgacaggtttttttggaacaagaaatcagttcagtgaacatttgtcaagtatcttctctgtaaaaagtgtaatgtgccaagctcagaagtaggaagtgaaatggataaactatgacccctgccttaaagaacaccatggtgttgtatgggaattgtttaggtagaatgaaagaaatcctctaatagagatatgaggccagttcagcagaaagccagggtgagatctcctgagagggatggaagggtgtcttgatcatctctggtagcagcaaaggcactggcatacagtggccactggaagacaaccagcaggggatgggggcgtttacccttgcaagtgagcattaggaactagaggactgattgccctttcttcagctttggtttcccttgctgcagaaaaagatgctgagactcatggcctcggttatgaactcagatatgtggtttggctttgaagcacagatggattttgtccgattttggcagggaaatgcctacagacagcactatgggcatatttaggttagggacgaaatgcaagttgattaagtcctgataagaggctgtgaagaggtccaagaagcctcacaatgcccaatgaagaaaagccctgtgcttggtgctgccgcctcccttccccgtcctgctggcagggctgcgcttcagtagctctggatgcgtcagagcagtccatgaacattctgtgtggaaaatctctgactgttttagtggattacactgctctccctttcctccagtgcctcgttattcagtattatttgatgttctccagcttttaaaataatcattttccgcctacgcagaacatcctgtagagacgttgaggttccagtgggaacagagaggaatacttattctaaaaatgaagaaaataaacctttttttatggagtgggtgatagtattgcagaacttctataatagtatgagaattcacttgtggtgccaaagcttaaaaaaaaagtatagtaaaaacataatgtataggcttattgctgtgctatgacccatgccccgttttctccaacctctcttgtcctcactcttcctttttgctggtgatatttttacttatttcatgaaaaaaaagataacatatacacacacatagatatatgcacaagtatatgtatatatgtgtgcataacacacataaacatatacattggtaaatttaaaaacatatttatgaaatatatgtagcatctacagaaaaacatgaacacttgtgagaatagcatctgcctaaaaaataggacatcaccatcacctttgaggctcttatgtgctgctcccctgtgccattcccttcccttcttccttagaggtgattactattctaaattttgggattattatttcctttttttattatagtgttttaattacagttttattacctgtatttgtattcctaaaaatttgtttacttttgcaagctttagattttataaaagtagaattacactgtaagtttaatttttctgtaatttatatatagctacacatatattcctaagattcatccatcttgttacatatagctctggtttaccttttctgtataatatagattctgcttcgtgaatttacagttcattcattcttctgttaaaggacagttggaggactcatatggcctcagtctctgtgtccccacatgccaccctgcttcccagcctcatatgagttgattggtggcctggcatactggatgagaagctctaggtcatatatttaagagagttattgctgggtcataaaatgacagattgttttccagaggggtcatattgatttaaattatcaccaacaattatattgtcagatttttaccagtttggtgattgtgaaacagtgtctgatggtagtttttatttgcattttcttggttgaaataaagttgtgtatttcagccaggtgcgttggctcatgcctataatcccagcactttaggaggccaaggtgggcagatcacttgaggccaggagttcaagaccagcccagccaacgtggcaaaaccccatctctactaaaaatacaaaaattagatgggtatggtgtcacatgcctgtaatcccagctactcaggaggctgaggcacaagacttacttgaacccgggagatagatgttgcagtgagccgagattgtaccactgcactccagcctgggcaacagagcaataactaaataaataagtaatcaattaataaataagtatatttcctcagctgttaagtacctgttcaagttttttacccaatatttgatgggctctttttttgtcttttctaattaatttttggagtttttgatatattctagatagtaatgagttacatgaaaatatccctagtttagggatcctctagtaactttttaaaatgaatacttgttttaggaacagaaattcttagatttaatgtaggcagattttatcaattgttctttacagattggctttgtagcttaagaaatccttcctaactttgcaataattaaagatatgctcttagattgtttcctaaaagactgatacttaagcctctagcccacctggaattgattttcacagatactacattttttactagttatagattggccccttcgtagagcaagtccgatagctgccatttttatggcagcatgtgctcacttagtgtctctgtcaaattttggtaattctcacaatatttccaactttttcattattactatatctgttatggtgatctgtgatcactgatctttggcattactattgtaattgtttggggcaccattaagctcactgtcttatgtgggcataaaccatgcccacataagacagtgagcttaattaataaatgtgtgtgctcagacccctccactgactgggtgttcacatgtcttccttactctcctcaggcctccttattccttgagacgcaataatatggaaactaggcaaattaataaccccacagcgtccacaagtgtttaagtgaaaggaagaggctgggcgcaatggctcacatttgagctcacaaatgagcccatgctcatttgccattccaaaaatcccagggcccttaagaattatgctaactctactctgcctctgctctataaatggaacaacaaagcctagatgacagcacatctttttagaacatgatttactgaatattttaagcccattgtggagacctactgctcagaaaaaaagattcctttcaaaagcctgtaatcccagcactttgggaggccaatgcaggtcgatcacctgaggtcaagagttcgagaccagcctggccaacatggtgaaacacgtctttattaaaaatacaaaaattagccaggcctggtggtagatgcctgtagtcctggctattcaggaggctgaggcatgagaatcacctgaacccaggaggtggaggttgcagtgagccgatatcatgccattgcactccagcctgggcaccagagtgagactacgtctcaaaaacaaaacaaaaaaaaaaaactgaaaggaagagcttaatgagaaaggcatattaaaagccagtataggttgaaagctaggcctcttgtgcaagttagccaagttatacatgaatggtaaagcaaaacagctttattgctgtaataaagaaagttttagtggtctggatagaagatcaaatcagtcacagcattcccttaagccaaagcctaatccagggtaaagccctaacttgcttcaattctttgaagactgagaggggtgaggaagctacagaagaaaacttggaagccagcagagattgatgaggtttaagggaagaagccacaagtgctgatgtagaagctgtagcaagttatccaaaagatctaattgatgaaggtggcttacactaaacaacagattttcaatgtagacaaaacaatcttctattagaaggtgtcatctatgacttacatagttaaagaggaaaagtcactgcctggcttcaaagcttcaaaagacaggttgactctaataggtactaatgcatctggtgactttaagttgaagccagtgctcatttgctattccaaaaatcccagggcccttaagaattatgctaactctactctgcctgtgctctataaatggaacaacaaagcctagatgacagcatctttttagaacatgatttactgaatattttaagcccattgttgagacctactgttcagaaaaaaagattcctttcaaaatattactgctcattaacaatgtacctggccaccctagatctgtaatggagatatataaggacatgaacactaacacagcatccattctgcaacccatggatcaaggagtgatactgactttcaagtcttatttaagaaatacatttcatagggctctagctgccatagatagtgattcttctgatggatctgagccaagtaaattgaaaacctctggaaagaattcatcattttagatgtcctgagaaacattcgagattcctgggaagaagtcaaaatatcaacattaacaggagtttggaagaaattgcatccagccctcatggataactttgaggggttcaagacttcagtggaggaagtagctgcagatgtggtggaaatcacaagaaaattagaattagaagtggagcctgaggatatgactgaattgctgcaatcccatgataaaatttgaacagatgaggagttgcttcttatggatgagcatagaaagtagtttcttgagaaagaacttaattctggtgaagatgctgttaatattgttgaaatggcaacaaaggatttagaatattatataaacttggtaaagcagcagcagggtttgagtggattgacactagttttggaagaatttctactgtgagtaaaatgctatcaaacaacatgacaagctacagagaaatctttcatgaaaggaaaaatcaattgatgcagcaaacttcactgttgtcttatttcaagaaattgcaacagcttcctcagccttcagcaatcaccaccctgatcagtcaacagccatcatcagggctagatcctccaccagcaaaaagataacaattcgccgacagctcagatgactgttaccattttttagcaaaaacctttttaattttatttatttatttattggagacagagattcactctgtcgcccaggctggagtgcagtggcacaatctcagctcactgcaaccaccacctcccaggttcaagtgactcttgtgcctcagcctcccaagtagctgggattataagcatgtgccaccacgcctggccaatttttgtatttttagtagaggcaggattttactatgttggccaggcttgtctcgaactcatgatctctggtgatctgcccacctcgggttcccaaagtgctggtattattggcatgagccactgcgcccggccagcaaaaaagtgtttttaaattaagctacctacgttgattttagacataatgctatttgcacacttaatagattacagtgtggtgtaaacataagttttatatgcactgaaaaacaaaaaatttcacatgacttgctttattgtgatattgactttattcctgtagtctggaactgaacctgcaatatctcagaggtatgcctgtatctacttgttctgtgatacttgttattgtcagtttgtttggatttaccacatattatttgatcataattctttcctgtagatgttttatggtctgcctaaacctttagtggggcctttgatggcttagtcctttcaggcttaagacaatagaagtttatttctcagagttctaaaagctgggaagtccaagatcaaggcaccgacagatttagtgtctagtgaaggcccgcttcctcatacatggcaccttctagctgtatccttacatagtggaagggaatagctagctctctggagtttctttcataagggctaatcccactaatcccaattatgagggaagacctaatcacctcccaaaggccccacctcctaatagtatcaccttgggggttaggatttaacatatgaattttgtggggacacagacattcaaacaatagccatggcaaacttttttgctttgtctaattcactcttattttgaaaagtatttgtgttgggtttaaaactccagattggtaattattttttcttagtgcattgaaggtaatagtgtatcattttctgatttctactcttgctcttgaaaattcagctatcaatcttaaaatttattacctgttgaaaatccagctaccagtcttatattttatttacttagtgggtaatctctcttctgagtacctttaagatctcctttcagaaataccatgtagtaaccctgtgtgtcacgtgtggattttgttgggcttgctagctgagacttgacagttttcatcacttctgggatattctcaggtattttgtcttcaaagtcttcagatattgtcctcttcctgccctctctccgactccttctggaacatgagttatgtatttattatctcccatgtgcataagttatctttacatattttcaatttctttatctttctgtgctacattctggataattttgttgatctaccttccagttaattagcttgttaactttgtcaaatctctttttaagtctatcttgatttttcttttcaattattgtatttttcatttttaaaaactttatgtgctcttttggaaatcttgatcccaggagatagtggatagtgtcctgctgcttactcatggttttaatagttcttgagcatgctgaacatacttattttatgttatttgctaatctttccaattcctgaaacctttacagatctcattctgtggattcttctggattctaattcatggggcattttttttgttttttgttaattcctcatactttatctgtggggaattacttgaagcctgggttgacaatgaaattctgcagagagaatttgcatttgattctactggaggaacagtcagccccgatatcagtttaaattaaaatctctgcttaaggttttcaggcaacctgcttagcatgaatcctggctggaaaagcatgtgaggaccagtttatgattacacattcacagggtgtcatgttttcttccaacaccaatgctagaggtggcagttttgcttactgcccttggagggacaggggagtgggcatgggcatagtagtatggttttccttttcactgggggtgcagcccttggagtctcagcttaatgtgttggggaagtggtctcctattagactctccatttcaaaccattccatgattttgtcctccttttgccaccttccgagcctgtaaaaactaatgtttgtgattcctgaggtttctctaatgtcttttaataaagttgacctcagagatctcgttacctctctgagttcctgctttgtcttagattttgatccttgagtgttctttaatcttttagcaattccttgttgcatgttaaaagattagttatattttattcctcatttgtgttcgttttcaccaggaggctcaattcaggcttctttgcttacttggtgtctctagttctggtgcctggtgctttggtcaatgaagtggggttggtaggattctattacttacctgttttttggttttattttttgttttgcagttctccgggagatgttgcataaccactccttcgtgggctgtgtgaatcctcagtgggccttggcacagcatcaaaccaagttataccttctcaacaccaccaagcttaggtaaatcagctgagtgtgtgaacaagcagagctactacaacaatggtccagggagcacaggcacaaaagctaaggagagcagcatgaggtagttgggagggcacaggctttggagtcagacacatgtggtttcaaatccaagttcgaccatttcccatttatttgactgtagacaagttacattcctaaactatgtctcagatttctcatctgtaagttgtggtattactagttaacatgcaggggttttgtttgtttgtttgtttgtttgtttgtgagggtaagaaataacccaagaagcctagtccttggtagttgctcagtgccctataaatgttgtgaaccaggtggtgagggtttggtgctgctagagaattctggtatctgctctgtgcaacagagtactgtaggtgatgcaagagaaagaagacctgatgccttctttcctcccagctttgagaatggagcaaaggcctaccccagccaccaagtgagccagtgggcttgatcagcacaggaaaggtgaccccggcagtttcatttgactattgcatggctggcaacatttctattgattgtttccagggaccttggcggatgagctcctgttgagtctagcatctctgttaaatctgttctcaaataggtaatgcatatgggaggatgctgccaccttgcatctactagacatcacctatctactgtgagactctccctctaagccctgctgtggcctcagagtgcttattggccctgtgagtggggcagccactatacattgcatggagttggtacatgagatagaaacctattcgccatcccttgaaactgccccagtccagaagcttcctgttagcacatgtacctccttgtatgtattcagaactcattccatttaggcttggaaacccgtttggtgcaactctgttcaagttccattgtctgctttgagaatgcttgggcttgtatagtgagctgtcactttttaatttgttaggaattctactcgccttgctttttcttttccagcatgtttaagggaatgacctccaaggccccaaatcacagttgtattcatgttctttcatttcacagatacaatccaggccagtcccagatttgcagctgttaataaatgtgaatggttttccagtaagggggtagaaaaacatagggagagaaccgggttcagagttcaatatctggattcaagtccttcctttagcactttactaactgatgtagaataagtcagctactcaataggtgcctcagtttccccaccaaaatgcagacatagaaggtgctttgtctgctttgatgagaagtctttaagcaagtctatggggttcaatgtgttttaagaactataaagtaccatataaatgtggcctttattcccattgtgttcttggaagtaattcaatatagtgtgtacttcatagctgcttttggactattgccagccagtgtatcatcctaaactacatgtcagcatagtataatcctgccttaggtctacttttgattatttaggaagactccctgcccttcctatacatttcacataatttttaataagttgtaaaaaagtgatttataggattctttgtaagtgggggaagttaagcagacaaaaagtttttaaatcttactgcagagtgtcaggaaccttttatagcaccagacaggtagggacagaacatgagtggcagcaagccagacttggtcttagtgctctaacctgtctgttagaggctggccagtcagacccctggttgaagacgttgggaatcccagctctttggaggggtaagagattttgttagactgttaaccagattccacagccaggcagaactatttctgtctcatccatgtttcagggattacttctcccattttgtcccaactggttgtatctcaagcatgaattcagcttttccttaaagtcacttcatttttattttcagtgaagaactgttctaccagatactcatttatgattttgccaattttggtgttctcaggttatcggtaagtttagatccttttcacttctgaaatttcaactgatcgtttctgaaaatagtagctctccactaatatcttatttgtagtatgttaaatttttctaaaacttctaaggatagttgctgtattgtatgatttgcatatggaggtatctataagaagttttatactttttagcaaaatagtcatttggtagccaacttaaacaaatgtttattaatatagaagttaataatatctactgatactcggccgggtgcggtggctcatgcctgtaatcccaccactttgggaggctgaggcgggcagatcatttgaggtcaggagttcaagaccagcctgaccaatatgatgaaaccctgtctctactaaattacaaatattagcagggtatggtggtgggcgcctgtaatcccagctactcaggaggctaaggcaggagaatcatttgaacccaggaggcagaggttgcaatgagctgagatcacgccactgcactccagcctgggcaacagagcaagattccctcaaaaaaataaatatctactgacacttaatacttggaaagggataaaaataaacattgtctaaagccgtggtccaaacacaacccctgccaacaattttagtccatttcttccaagacttttttttttctatgccttttgtgaaaactgtcaaaaactttttcaatgctgaattttagttctgagttaaaaatcatactacctgtttatatggtttcatatccacttttttcatgtgatatactctacaaaaagcctgctgagattttgattgggattatgttgaatctagatcaatttagggtgaaaaacttttgttagataaatcccttagtatttcacatttttaaatgctaaatggcatttttcaaaaattttcttttttcttttcttttttgagacagagtcttgctctgttgcccaggctggagtgcaatggcaaaatcttggttcactgcaacctccgcctcctgggttcaagcgattctcaaactgcctcagcctcccaagtagctgggattacaggcatgtgccaccatgcccggctaattttttaaactatttatagtagagagggggtttcaccatgttggccaggctggtcttgaactcctgacctcaggtgatctgcccaccttggcttcccaaagtgctgggattacaggtgtgagccactgcacctggcctcaaattttttttttttttttttttaagagacaggggtctcactcttgcctaggctggagtgcagtggcgtgatcataggtcactgaagctttgaactcctaggctcaagtagctaggaatacaagtgtgtaccactacacctggctaatttttttaaaaaaatttttttcgtagaaacgggagtcttgtgttaccaaggctaatctcaaactcatggcctcaagtgatactcttgcctcagcctcccagagtgctaggattgtaggcatgagttacttcacccagccaaaaaacttcaatttcctattgtttatttgctagtatatagaaatacatatagttttgtaccttgatgctgtatcttgcaaccttgttaaactcacttactagttctagtatattttttgtagattctatcagattttctatatatgtatcatgtcttctgagaataaagaaacttttacttcttgctgtgcaaactgaacaccttttctttctttctttctttttttaagacggagttttgctcttgtcacccaggctggagtgcagtggctggatctcggcttactgcaacctccacctcctgggttcaggcaattctcctgcctcagcctcctgagtagctgggattacaggcgctcgccaccacgcccggctaatttttttgtatttttagtagagatggggtttcaccatgtggccgagctggtcttgaactcctgacctcaggtaatctgcttgtctcggcctcccaaagtgctgggattacaggcgtgaattactgcgcccggctgccttttatttctttctcttgactgactgcactggctagagcctccaatacaatgttgaatagaagtggtaagaatgggccaggcatggtggctcatgcctctaatcctagcactttgggagagtatggtgggcaggttacttgaggccaggagtttgagatcagcctggcgaacatggtgaaactctgtctctattaaaaatacaaaatatagttgggtgtggcagttcacgtctgtaatcccagctacttgggtggctgaggcatgagaatcacttgaacccaggaggcggaggttgcagtgagccaagaatgcaccactgcactccagcctgggcaacacacacacacacgaaaaacgaagtggtaaggatggaaatccttctcttcttcctgatctaagggggaaaggggaaagttacaaaacattcagtatgctgttagccatataggtttttttgtagatgcccattatgaggttgaggaagttccctctgttccttatttgctacagattttatttaggattggatgttgaatttttttcaaatgctttttttgcatctactgagataatcatatgatttttcttttatagtttgttaatatagtgaattacattgattttcttatgttaaaccaatctttgcattcctgggatgaactctgcttggttataatatataatcctttttatttattatgggatttgatttgctaaaatttttattataattattttatctgtgctcatgattgttactagtttatagttttcttttagtctttggtttttgtatcagggtaatgctggcctcatagaatgagttggtaagtatcccctccttttccattttctgaaagagttttgtgtagaattgatgttaaaattattgcttaatgtttggcagaactcaacagtgaagccatctgggcttggagattttcttcatgggaaggtttttaactgcaaattctatttctttaatagtatagagctattcaggttatctgtttcttcttaggtaagctttggtattttgtttctttgaagaaatttgtcgcatttaatctaaatttttaaatttactgacataaagttatttataatatttcttattcttttattatctatggatctcttggtgacataacctctctcattcctaatattggtaatttcaggcttttctttttaacttggtcagtctggctagaggtttatcaattttattgatcttctcaaagaactaacttttggtttcatagatttttctattttctatttcattgatatctgctctgacttttaatctttcttatacctattttggtttaatttgtcttctgtttcacatttctttttttttttttttttttttttttgagacagagtcttgctctgtcgcccaggctggagtgcagtacagtggtgcgatcttggctcactgtaacctcagccttccaggttcaagcgattcctgtttctaagcctcccaagtagctgagattacaggcatgcaccaccagctaatttttgtatttttagtagagatggggtttcactgtgttggccaggctggtctcaaactcctgacctcaggtgatccacctgccttggcctcccagagtgctgggattacaggtgtgagccactgtggctggcctgtttcacatttcttaaggtagaagctgaggtcacggatttgagacctttcttcttttctaatacaggtgttaagtgctacaaatatcccttaagcactgcttcaacagcatcccacaaattttgatagtttgttttcattttcattcagttcaaaataccttctaatttcccttttgatttcgtctttgacctacaggttttttagaactgtgttatttagtttccaatctcttgaggatttttaaaacaatatgttattgatttctaatttatttccatctcagtcaaagaacatacttgcctttttttatacatttattgaaactttttttatggcccagaatatggtctgtgttggtaaatgttccatgtgtacttgaaaataatttgtattctgatctcattgagttgaatgttctaggtatatcaagttgatagtgatgcccaagtctcctgtatctttactgattttctgcctgttctgttattgagaaaggggtattgaaacttccaactataattatgatttgtctgttctctttgcagttctcttagtttttgccttcatatatatatacatatatatgtatatatatatatatttttttttttttgagatggagtcttgctctgttgcccaggctggagtgcagtggtgtgatcttggctcactgcaagctccgcctcccaggttcacgccattctcctgcctcagcctcccgaatagctgggactacaggcgcccaccaccacgcccagctaattttttgtatttttagtagagacagggtttcaccatgttagcaaggatggtctcgatctgacctcgtgatccgcccagcttagcctcccaaagtgctgggattacaggcatgagccactgcacccagcccatatattttaaagctctgttattgggtacataaacatttaggattgttatatccttttgataatggactcttctattatgaaaagataatatactgtgggtttataacatatgtaaaagtatgagtaacatattatcagaaggggagaaatggaagataacttaggcatcttatttttaagcatagttttccctttgtttctgcattagatgatttacctgaaatgtcattcaatttaacttactctccatcctcacccgcccagctttggttatgaggcagtagaaagaaatgatctgcctgtggttttctagaaatacgaaagttgagtccttaaggctacacagaaagaaagtacctccccagggcttcacccttcccatcctttcagcaggctttttgtctgtcgtatcttctctgttgaaatggccattgacaagaggaggaaaggggttttgttgtggattgttcaggcacttcctttggggtatatgggggatgagtgttacatttatggtttctcacctgccattctgatagtggattcttgggaattcaggcttcatttggatgctccgttaaagcttgctccttcatgttcttgcttcttcctaggagccagcaccgctctttgaccttgccatgcttgccttagatagtccagagagtggctggacagaggaagatggtcccaaagaaggacttgctgaatacattgttgagtttctgaagaagaaggctgagatgcttgcagactatttctctttggaaattgatgaggtgtgacagccattcttatacttctgttgtattcttcaaataaaatttccagccgggtgcggtggctcatggctgtaatcccagcactttgggaggctgaggtgggcagataacttggggtcaggagttcaaaaccagctggccaacatgatgaaaccccgtctctactaaaaaaatagaaaaattagccaggcgtggtggcgggtacctgtaatccaagctgctcaggaggctgaggcagaagaatcacttaaacccaagaggtagaagttgcagtgagccgagattgcaccactgcactctagcctaggcgacagcgagactgcgtctcaaaaaaaaaaaaaaagaacgttccaaggtcaggactaggcctcccctcagaagcagcaagtgacatatgtgacatcctctccactccctatttgcatttctaggttatataactgtactactatccatgcatgcctactcttgttcccagggtgaaggacccagacatggagagccgaatccctgcaggccattataaatgagattatgccatttgctcccatttcttcttattctttcatttttggggctctccatcttgatgtgttctttggatcgtgaacagatccaaagaaaaggttgttctgccgtgctgtttgtcaggatgaaaaactcttttttaagtgtttaggtctgcccccagtgcccagcccaatcaagtaacgtggtcacccagagtggcagataggagcacaaggcctgggaaagcactggagaaatgggatttgtttaaactatgacagcattatttcttgttcccttgtcctttttcctgcaagcaggaagggaacctgattggattaccccttctgattgacaactatgtgccccctttggagggactgcctatcttcattcttcgactagccactgaggtcagtgatcaagcagatactaagcatttcggtacatgcatgtgtgctggagggaaagggcaaatgaccaccctttgatctggaatgataaagatgataagggtgggatagctgaaggcctgctctcatccccactaatattcattcccagcaatattcagcagtcccatttacagttttaacgcctaaagtatcacatttcgttttttagctttaagtagtctgtgatctccgtttagaatgagaatgtttaaattcgtacctattttgaggtattgaatttctttggaccaggtgaattgggacgaagaaaaggaatgttttgaaagcctcagtaaagaatgcgctatgttctattccatccggaagcagtacatatctgaggagtcgaccctctcaggccagcaggtacagtggtgatgcacactggcaccccaggactaggacaggacctcatacaatctttaggagatgaaacttgcccatctctaaaatttcgggatttctttgtacccaacaaggttcaaacacaacagtcagcttttattcatgatttttacttccatctgctgatgtagaacatacctccagagtgacctcagaaattgtcaaatgtgaaaacacaagccatcacagtgagaaatgggaggttgagttagattgtctaaggctggagagtccatatactcccactgttagctctgaagtgtgtagccagtcttcagattctgggtcagttgcctcagtctctcttagcttttgccttactctttatccgaccactgccctgccaggaaaacaaggctctataactcctcttacaggtcagcttgacacaaaaagggtgcctggattcctaatgtttcattgtcacttttcccagtcagatgataatgcttttcaaatcaacatatattttgggggaggttggaagggagagttgaaatattctaagaatcaaagagtagcccactttaatcagagtatgacccctgattgctcacagtcatctcctgagcagtgtgagcgagtttcagatgaggaggctgaaggccagtcaggcatgctcgaggattccaagtctgtaggtgggagggcagagatttagtcctgttggccaaagcctctagggaatttctcactccagtggagaaggcaacacacttaccaaactgtgtggaaactatctcatttgattagaaattttacctcaagaagaggaaggacagttgagaaagaacattttcttacacatgagacagctaaggcttacaagaaggagaggaataatgaggcaaaataatcctcattaatattttcattcctcccctggggattagaactactttcagacccgattttaatggtaagttaggtacttcctacagttgccatccaaatatcagtcaggatcagacatgatgttagctcctgctacaataaaaccattttctccctgaatgaaaacaaaggttccacaggagacagtcccacagagcagtggcttcttttcctccctttaaaacctcatgttggctggacacagtggctcacacctgtaatcccagcattttaggaggctgaggtgggaagatggcttaagcccaggagtttgaggctgtagagctatgatcacaccactgcccttcagcctgggtgacagagcaagaccttgtctctaaataaacaaacaaacaaaaaatcctcttgtgttcaggcctgtgggatcccctgagaggctagcccacaagatccacttcaaaagccctagataacaccaagtctttccagacccagtgcacatcccatcagccaggacaccagtgtatgttgggatgcaaacagggaggcttatgacatctaatgtgttttccagagtgaagtgcctggctccattccaaactcctggaagtggactgtggaacacattgtctataaagccttgcgctcacacattctgcctcctaaacatttcacagaagatggaaatatcctgcagcttgctaacctgcctgatctatacaaagtctttgagaggtgttaaatatggttatttatgcactgtgggatgtgttcttctttctctgtattccgatacaaagtgttgtatcaaagtgtgatatacaaagtgtaccaacataagtgttggtagcacttaagacttatacttgccttctgatagtattcctttatacacagtggattgattataaataaatagatgtgtcttaacataatttcttatttaattttattatgtatatattgtgtcagttcagatgccaaaaagaggtcttgaacatgtcacaggctctgatggcactgaccatggagaaagcttgatttgatcatctggtgtctacaataaccaaagctaattattaaggaaaaaaacttgaagaaagaaaatagtccttacttcatctataatgaggtttttgtttttttgttttgagacggagtcttgctttgttgcccaggccggagtgcagtggcgcgatattggctcactgcaacctccgcttaccgggttcaagcaattctcctgcctcagcttcctgagtagctgggattacaggcacctgccaccacgcccggctaatttttgtatttttagtagagatgtggtttcacgatgctggccaagctggtctcaaactcctgacctcaggtgatcctcccacctcagcctcccaaagttaagtgctgggattacaggcatgagccactgcggccggcattaagtatgagtttttaagttagcccactttgttaatgactatgagtactaatagcttaagataaagaagtttctaggtaatcttgtttgaaggatgatgtaaaaatataaatttaaactgtgagtgacaaaataaacttccttaatatttgcctacatttagagaaatggagcattcagctcagaaaggaagaatgtctgtggttttaaggtaaaatccatattccaagactcagtgaagaaagttcagtgataaagaacagactactctcatcttatgaagaaatggagcaatttcacttggaaagactaggaagacaaaatgttacagacgtatttgttgtgccacaaaataggcaaggtcagttttgaacaataagaactccataaagtagaccagggcatctcagaagtgaggttccatgagcccaggtggggcacaggctgggtgatcttgagtggagaggaagaggggttttctgagcttcaagagctgggccacacagtgtgttggttttagctgggatggagttctagaacaaacctgcactttagaacacctttctacccacccccaaccacacaacttgctactattagtaaatgtataggctgaggcacggtggctcatgcctgtaatcccaacactttgggaggctgaggcaggcagatcacttgtggtcagtagttcaagaccagcctgggcaacatggtgaaaccctaactctactaaaaatacaaaaattagcagggtgtggtggcagacacctgtaatcccacctacttggggggctgaggcaggagaatcaagcttgaacccggaaggcagaggttgcagtgagccaagatcataccactgcaccccagcatgggtgacagcacgagactgtctctcaaaaaaaaaaaagaggccaggcacagtggcccacacctctaatcccagcactttgggaggttgaggtgggcagatcacttgaagtcaggagttcaagaccagcctggccaacatggtgaaaccccatctctactaaaaatacaaaaatcagtcgggtgtggtggtgcacacctgtagtcccagctcctcgggaggctgaggcagaagaatcacctgaacctgggaggcagaggttgcagtgagccgagatcgtgccactgcactccagcctgggtgactgagcgaaactctgtctcaaaaaaaaaagaaagaaaatgtatagaaaatcatctcaattcagaagattggtatccatattttttaaatgaagggctaattaaaaaaggaacaaatattagagattttattcacttttgagttacctttttaaagtctagttttattatcttatgtgcctttagtcactagattttcccccaatatattttctgtgtaagcactttaaagatacaataatcatttctataaaaccacctgggtactaagagcaaaagagaatcataaattctgcaaagtagttgcactccatgattttaaaaaaacctcttggacagggtacctctaaaggtgaaactcaagtctttaaaagttctacattccagattgtttttccttgagaaggagacaaaagaagagggatgtggttgccatgatttgttttaaagtctcctataacaaaatgaacatgtcagtagccaattgtggttggcaaaagggtgtatttaatagaatctgcaggcagatttccaatctgcctgccctgccctaccctccccctttgggtttgtttgaggtttcattccacaaataagcagcagataaaatactttacaaggtacagcacagttgtattgaagaaaaaaaggacccaactcttactttaggagtattaggcctggacttcccctgccccatgcaataaagcaagttttatatacactccccatatttttttctaacattttcttatataaatttaaatattttacaaaaaaaggcttttttcctccaaacatataaatctgagtgaaacatagattccccacccgagaacttgtttcttcactaaaatataaatgttgtctgatattaagggtaaatgtcttttgaccactggagatcactgaagtctgaattgcaccgtggagaaggcacttgtgttttctgaggtctccagcaagtatctcagtgagcactcatagaattgctgtctgtcctccagaacccgtgccaaggcctccgagtgcccagttactgaggcagctggggaaaaacgttgagtaaacatgattctacaattacggagataaaaaataaaaacagcatggactggttctaccctagaatcaaactacaacaaaatccaaagtgttcattcatgtagattcaaaatgacttcattctgtcataaattataaaatacaaaggtggctgttttaatgacaaaactcaaaacagtactaaaaggggtttgtgtcaatggacaaaagtcagtccctctaggtagggccccaaggagcatcacccaggttgaagggtggttttcctactgctgggccagaagtgctgtcctattggccttcatcttctccagccgcttggccaggtggctgttggtcatctccatctcctcaatcttgtccagtgctgttcgtaactggagacagggagaatgcagtcactacatgtggtcagaaacaacatccagtgctactctattttcaacttcctgggaaatgaaagcactgctaactgtgatggccttgcacaggacccacaacctcattttttctatcagttagaggtgttaaatgatgatactgaggattgtttatttgttttaatcacagaaaggatatatagaagttggagaaatagacctgatctgaagcaaaaatacaaactatctttttacttagtatctaattgaccaaaacataaaagtaaatggcagtcactatgcaggtcaaaaaccaacacaaattagttaagtgactccactgctgtttccttaagtatcaaatttcttacacagctaagaattatttccagaagattttttctttttaggaatgtattctccaagaaacatattaaaagaagtacctctcgttgtagcttccgtttttctgctttcaattcatcttcaactttctcagcattctcagcagcagttttatatctcagaacctgtccctcaagccggctaatctgtaagtatgagaacataggcctctagtactgggcactagaagtcaccactttttggtagccaggatggaaatacaatgtcattataaatgccaagtaatctactaacaagtcccctaagggtgactcataagtcctctcagaactcagttgctatttataaatcaagtaatgtccccagagaggattacagctgtagagtcattttagggccaatttcccatgctaagttttattatgaccatattgtttaagtgccaaagcaatataggaagagacactaaatggaaaagttcttacactttttggaatgcgtaagggattttattacaaatgatgatcttgaattctcctgaaatatctacaaaaactgatagctatagtttcctatggttttagagaaaacagaaggctaaaatgtcccaacaagtgctctctgctggcttttctattttaatacagaactattattgatccaactgcaaaggcaacccaggcactcatgggttgttagccacttagatgcaggaaggacatttaaataacttagtaccatatagaagtacttacactttgctccaaggtagttatatcctgttctgcttttgaaagcttaaatttgtattcgctaatttgtctattggcatctcctagaacagaagaagacaatgaattatcttcacctgtcagagatgacagtatgagccatcaggcagtacctctgtggcacagagaggaccatgcagtcttaagattacaaaatacagggctgggcgcggtgactcacgcctgtaatcccagcattttgggaggccgaggtgggtggatcatgaggtcaagagatagaggcgaccatcctggccaacatggtgaaaccctgtctctactaaaaatataaaaattagctgggcgtggtggcacaggcctgtagtcccagctactcgggaagctgaggcaggagaatcacttgaacccgggaggcagaggttgcagtgagctaagatcgcgccactgcactccagcctggcaacagagcgatactccgtccccctgccaaaaaaaaattacaaaatacaaatgcacacacaacaaccacagcatcttcagcagcccaggttctggactgtatatactacaagatgctctagcatatatgttactacagtatcccttgcagcaagagttagaagaaaattctttaccctatgatatgtgtgagcagggcttgagaaaggagccctgccaattcagcagcagcccctaccaaccctgtgtgtaaccttgtggagcctccctgcccacgggactgggccctctagttccctgaacgcggccccatgccttcccatctcccaggttttgcttctgctgtccaatactgtaagggtccttttctcccacctctgacttgcttcaaggccaagctcaattttcacctctttcatgactccccttaattataagtccttcccttgctgtattttatttgcatttttatgacatttgtcatgctttttaaacatcgtatgtgtaagcaagaagaggggccctgtcttggccttcctaaatctacctatgtacctagccaagtgcacacagtgtatgcctaaataaatatatgttggaataaatgctgttcagtaatgtgataatgtgttatgggtagagctataagttactagatgaacatctgacctaggaagtaaatcacttaaaatgaaaagtttagaaatgatggcaggggacttttaaaatccctccaagaatccaagtttagcaaaaatcagtctctggcatgattacagtaataagatttgcaaaagataaaccaaatctaacataccacaggaaatattcagattatctaacttaagaacttttctacatttccacatgaccaaggttacaattacttatacagtcttcaatgtgagaggtttttctttttttttttttgagatggagtctcgctctgtcgcccaggctagagtgcagtggcgcgatctcggctcactgcaagctccatcacccaggttcacgccattctcctgcctcagcctcctgagtagctgggactacaggcacccgccaccatgcctggctaaatttttgtatttttagtagagacggggtttcaccatgttagccaggatggtctcgatctcctgacctcgtgatccacccacctcagcctcctaaagtggtgagaggtttttctaattggacaattactgtcaccttaaaaggaacagggttaccatctccccaaaagccatatctggtagtgaaagagaagtattcctatttctgagccctaaaacaagcttcaggatctgatttttaaattgttatcctcagcaatctattgattatccaaatgtacttcttccttctcactctccaaaccacctttcccttcctgttttcaaaagtttaagtctcttatctcagtaacttcatgtgtgttttgaaatcccattccaaaacactctcataataggcaaggcaccatccagaaccaagagttgctccactcctggccttctggtccagggaagctgcttgcttttgtctttgccagctttcccacagtcctgcaaagctcactttgttctacacctcctgcctgggtactttaccttctgcaaataccagctatacaacaacctacctactctaggaagtattcacacataaatgccagcccattccccctaaatctgtttccttttaaatttgctgcttaaggacaatctctcagatctattccctaccctctctctaagactgctgacagctactgaactggttcaggctcaccactgtagtagcttcctaactagtcagcctgccttttcccatgtccctgttctcatctaccgccaacaccaaaatgacattcttgaacaaaatattcaccaggaaatgtcacaagtgtcctaactgatgtccaacagaaaagataataccaatatcaaaagttagtattaataagccttaacccaaaaagtcttttctcttttttttttttttgaagagacgggttttcaccacattgcccaggctggtctcaaacttctgagctcaagcaatccaccacctcagcctctccaaatgctgggattatgggtgcgggccaccacgcctggccccaacatgtcttttcttggcagcctatctcagaaggtttagatgaaaagtccatggaataaacaagattttaatattagttatcagaaaagtcactattcttattggaaaaatgaaaatctcctctgtccgagaattacacataatcactaacaaaggctaactacaaattcctgctgaaatcttcctactatgggaattagtgtgactgcagtgatcattttattatgaggtcagaagtagaaaaatgagaaaaactggaataattcgggtaaaatgaatagaatagactttattttgtggacttattttaaatttcatctaataaagataaacttggattaacaaaatacttctaggaaaattctgaaactactcaatttagtgtgaagtagttccaaatagattcgtccaattatccaagacaaattccagagaaaaaactttaatggggaagggtgcttgctgtatgggagcttaaagatgacaaatggatgtggaaaaggacagtgccaggttgtcaaaaggcatttcactgtgtgcaaaaagttcctagaaatcactttatccagaaagggtaagagcaataaacctcattatcccctgaagcacacaggctagtggagcctctattcagctatattgctgactaggactgtttttctggactagccaaggactaaccaatttttgcagcatagctcttcttaagaaaagcatattaacggccaggcgcggtggctcacgcctgtaatcccagcactctgggaggctgaggtgggcagatcacctgaggccaggagttcgagaccagcctggtaactatggtgaaactctgtctctgctaaaaacataaaaaactagccgggcatggtggcaggcgcctataatcccagctactcaggaggctgaggcaggagaattacttgaacccaggaggcagaggctgcagtgaacggagattgcaccactgcactctgacctgggtgacagagtgagactcccatctcaaaaaaaaaaaaaaaagaaaagtgtattacaagataccagcaacctgctgacaaacccacccctgggacacagtctatatacagactgggactggcctgtcccctggtacctactctgcatttcgatgaactgcaagtctgagccattctgcagtcctgccaggtcacccactgtgccatcattcctggagcatttctgtcgttcctcctctaactgaagcttcagttttctaatctgaaatgaaaataaaggttcatcagcaagatccaatctctcaaatgaagccgatgcttattctatggtcacatcatagaacaaagcagacccttatcgtatcagccacattcattcaaaacctattttcttgagtgcctaataggagacacacatcgtcctaggtgctaaagataagctacgaacaaacatcgaaaagagcaagccccaggaccaggtgtcccagtagaaaatagccatattttaaatttgtgtctgcttatggaacagtacatctttggggtattttttgttacttttatttaaaatggaaaattctagccaggcatagtggcatgtacctatgtatcaggctacttgggaggctgaggcatgaggatcacatgagcccaggagtttgagaccgacctgggcaacacagtgagacctcatctctaaaaaaaataaaacaaaaatataaacagttaactgatagggtatattcaagagattatttcttaaaatggaagattccatgagcagttttttgttgtttacttttagacataggttaaattttcttacttagaaaacatcctgtatgtaaaaataattggggctgggcacggtggctcacgcctgtaatcccagcactttgggaagctgaggcgggcggatcacaaggtcaagagatcgaggccatcctggccaacatggtgaaaccccatctctactaaaactacaaaaattagtggggcatggtggcacgcgcatgtagtcccaactactccagaggctgaggcaggagaatcatttgaacctggtaggtggaggttgcagtgagtggagatcacatcactgcactccagcctggtgacagagcgagactctgtctcaaaaaaaaaaaaaataataataataataattggatacatagagatggcttccccagctgtccttaactccaccaacaggggtcaaagggaggcctctgcactaagattaagtttgccactccccaatgggaaaagggtaagctctatattgggactaactctatacttcccaggcacctctgccctttcaacacacagggtcaccatcattagctgccttgagggaaccaggacaaatctcagtatctccatcattcctatttatgtgcatctcacaaagggtcatatccttcctctgcagtcttcctcacaagggtctgtacgaccactaaccttcatctcctaacctttcccaatgcctgaaacttttccactgggccctctagaattatcagtccatcatcagcaaacaccctctgtcctcagtcttttctgagcatcccccctttaccctcgtgctctgataaccctctcctgctgcttctgcagctctctcaaacactgtttttgttttgttttgttttgttttgtttgtttgtttgagacagggtctcgctctgtggcccagactggagtgcagtggcatgatctcagctcactgcaacctccgcctcccgggttcaagcgattttcctgcctcagccccccgagtagctgggattccaggtgcatgccaccacgtccaatttttgtatttttagtagatggggtttcgtcatgttggccaggctggtcttgaactcctgacctcaagtcatccacccaccttggcctccccaagtgctgggattacagacatgagccaccatgcccggccctttttttttttgtacttccacagcttcctaccactgaatctagaaatggaataggtgtcctcttgctttccttgctggtattttccctccatcttccctaaaagtcccaggtcttaatctcgtctcttcaaattatatacactaactacttatcattgccaaaatcccattccttcatcaccatttattaaatagctcccaacttgcactccctctagactattcctgtcttaatttttggcaatttcaatgtacatctaagtagaggatctcccttacaaatgatctctcaatttctggtatatctcctcttacggtttggatgtctgtcccctccaaatctcatgttgaaatgtattccccagtgctgaaggtggggcctggcaggaggtatctgggtcatggggcagatccctcatgaatagctttgcaccattcccttggtgatgagtgagttctcgctctggtagttcacacaagatctggttgtttaagagtgtatgttacctccccactctctctggcttccgctcgagatatgacgtgcctgctgccccttcaccttccgccgtgatgagaagtttcctgaggctggctgggcgcggtggctcatgcctgtaatcccagcactttgggaggacgaggtgggtggatcacctaaggtcaggagttcaagaccagcctggcctgaggcctcaggaaactgagctcagaagctgagcagatgctgacaacatacttcctctacagcttgcagaaccatgagccagtttaaacctcttttctttttctttttcttttttccttttttttttttttgagacaaagtctcactctgccacccaaggctggagtgcagtggcgcaatcttggctcactgcagcctccacctccctcctgcctcagcttcccaagtagctgggactacaggcacccaccaccatgcccggctaatttttgtatatttttagtagagttggggtttcaccatgttggccaggctggtctcaactcctgacctcaaccacctgcctcagcctccaaaagtgctgggattacaggcatgagctgctgtgcccagtcaaacatcttttctttataaattacccagcctcaggtattcctttatagcgaagcaaaaaatggactaacccacctcccttccaaggatcttgctatctatcccttcttgccctcagctactcactcccacagtcatataccagatctcatcattagacaattgtaatccctacacaatttagttccatgtatcctctctctaaccactattcctcatctttccaggtcattctctctagacccgaattccaacaacccttcaaccacactggtaccactaatctacagattacatcttctttctactataccttgatgtgttcctgaatatctcccgaatcctcttcatccagtttaatttcaaggtccatcattataatcattttcttacatactccctcacctctcctgccccattaatactgtcctagtaaaatctagctctctacccactccatgcctgcccctatgctgctgtaagtagccagagaaacacatataataaatgcattcacacaaaccttctaacatatcatataatattgtctgatgtcttcctactagaatgcctctcaggcaggaattttttttttctaaactaatttattcactgaaatatcccagtgcctagaatagtgcatgttaaatagtagaatctcactcaacatttgttgaatgactgaataggagttccaaaatagagaacacagcatatgggaggggaaaaaaatcagtaacaaaatcattcaagaaattttcccagaactaaaggatgggagctcctagaattgacaggggcccagcatcacacatgaaaacttcaaatcacatgactatcttcaaattacaccagaatgctagagagaaagagaataggatacaagcttccacaaagaggagaaaaatagatcacaaatcagaaaagatcagaactcaaaatgttcatgaaaactcaacagccatgctcgaagtcacagcacaatgaagaaatgtccttttaaaaaatcttaaggagaaccatggcaactcaggattctctacccagccaaactattttaatcaagtgagagggtagaatgaagacatcttcaggcctgcaaggtcatgaaaaattaacaatccacaaaccctcttctcaggaagctactggaagatgtaccaaaataagagaataaataaggagaaaggcatgagacaccggaaaaagggaacccaacctaaatcacatgcaaagaaaatctccagatgccaatgaagggtgaccacatctatgtaccgagagggcaagtcactagtttagaaagggacaagtcagatgcaccaagattcaacaaactggaactgaaataacaccagatgcatctgaaaatactgagtgggattaatctactcttggagattctgtggctaaattgatgatagaaaaccaagcaaatacaaagaaaaaccataacattaactttagaggaaactaatagttctgagggagatgatcctagaatgcaacctggctccactgtgtgagtagtgtttagagggtcctaatgacacaagcaggctggaattacactgttcctttattaggaggatataagagtggaaaataagtatgtgtgtggcagggacaaaggatgaaaaacagctaaatcctcatcttccataaaaggatgtcaatatagaatgcctgaagcagaacaatcaagatgcaacataagtatgttatacagagatacaaggacagtacacaagaatcagctaaaagtatttaacagaaatggtcaggggcgaggtcagaggagccagggcaggggactgctgtgttcataacaagctttgtaaaaaactatatgactccttaaactatgtgtccttaaaaaaatgttttaagaacagaaaataacaaagaggtaaaatatgaattatctatccttcatatctcacttgagtactgatgtttgaaagaagcatatttttttaatgaacatttcaattagccagtattttaccatgtaactttgttaaaattatattacactccaataagaatgcctttacctgtgacagtagttcttccttctctccagcaagttttcgtagccttacatctaaaacaaatgaaaaagatcataaactaaatatgtgatgatatagtacataaacaattaaaaatttttcaaactcataaacagctaatattatctgataaattacattacttacagctctgaatatctaaagaaataaaggtgttaatagcattacagaaaagttcttaactatctaaaaagtatttccacacaactgatatttatcagggcaccaaatccaacatttgttccccacagcagtgatttgccacttaaagacaaacagaagtacaaaggaggtcatttccttgtttcaagctttcactagtagacagacaactcaaatgtcaagtgtgttcctaaaggctgagcccttagcgggagagatccaaatatgtgaaagaagatggggtaagagcaggactgggcaaaggaagctagagaagagaaaagagaggagcataatgctggaagaagcaaagtccccaaaagctagtagggagggaaggggacccactccaagatgtgggcagccaggccaggtgtggtggctcacgcctgtaatcccagcactttgggaggcctaggtgggtggatcacttgaggtcaggagttcaagaccagcctggccaaaatggtgaaaccacgtctctactaaacaaatacaaaaattaaccaagcgtggtggcaggcgcctgtaatcccagctactcgggaagccgtctgaacctgggagatagaggttgtatgttgcagtgaactgagatcgcgccactacaatcctgcctgggcgaccgagtgagacttcgtctcaaaaaaaaaaaaaaaaaagatgtgggcatccatgggtagatctgcggcttggtggcagcaccattagggctcactcctagcctgtggaggtttgactcttcccaagcctgcattaaaataggccccttcagctgaggagataccatggttcacttaaaaaagcagctgatacctcgccaaccactaccctctgtaaacagggtcatagccaaataaagattttggtttcttctgcaccttccaagcagatctgcctgcttggacctgcagacgagggaaaaaacagcagggaaacactctgggctgcctatagccagactctcgttccattctccagatctctcttgctcacccagcatcctgttttattcaaagtgccctacaatcacatttctggaatgcacattagagaatgtgcttactaactttcaaaatgtttttcagtttgcttcacacttgtatctctcactcctctaagaagcttacacatatatgaaaacaagatgaaaaacaaaaaaattgtttttttttaaaataaaagtgagctaatgatacagtatctatctgtgccatttttcttcctctagagtagatttctttgtggggtcaatggatgggtgactttgatttctcagacagaggtgtcagcaactttgtggtttcctggagagaggtgtcagattctcaaagggttaaatttaagaggtttagactttaagagtctgggaagccctgctctggaagtcatacttctctgatatctttttggtcatctgtttcttggcttaagaaatgtggtggaaaagaggtacagaaccctggggtaagcagtggaacataaaaccagatgttccaaggatgagaaacttataacacacttgagaagtctcctgctagcctactgctcccctagcacaggtatactagactatctctttgcagaacagtttgtagttaagtaaaaaccgatgtgtataggcccatagtacttccatccacaggccttacagttacacttattgccttacagtgacccagatgctgatttcccaaggtcaaggatgtctgaagacaatgtgccaatgtgcccagattcttctagttaaggatctacttgagtctcagcccttatgctgtttttgttttccaagctgggatatgaaaaagcagaaaacccaatagggtaacattaatccaagtcaacatagcaaccagtatcttacctaatggcccttctcctgctgactccaagacctgagcagcttcctgagacacaacagtgatggctccagccactggttcatgactgacatcaccattgggagtgccatcggggattataactaagccatgtttctgcaggggggaaaaacccaccatcacaaaaggcccgtatggaagctgtaagctctgtgaggtcactctgcaacaatacatgtttgctacaggtaaaacctggttagaatcagttacatgaaatatagctctgtgtaagaaatagcttcaacctaccaaatctggattagagaataaacactgtagtttgtatttaggctaggaaagatggcaggatgaaaggaaggaagatagagagtaaaacagtgagggacctgaattccaggctaatgctaacatacctctcccgtcttcactgtctcctgcaggtcagccagctcctctctgagcatatctcgctcattcctaaggcaggcaatgtattctttctgtttctctagggcctggttttaggtaaggtagcaagggaaacaatggcacagaaaaagagcaggtgaaaggtagcagagaagtacctaattcaaataagcaaagataaaggcataaaaagcaagaaagcagtcaaaagattggaaacaaacagtcagatatgggaggaaatacagagttacatggatatacatctccagaagagacttctcatagaaactggttctcatgcatcaatttggcaaaacatgtttaatcacatcaagcagggaaataaatcttttccagtcaatgaaaaaaataaaacaggaaaaggaagataaagagagaagccagagtaaaataaagctttccttactgactgcctaagtgcatttttatttggtgaacaaaaaaaaccccacatttcatgtttaactaaactagtttattcaagaatacagttgattttttaaaaaatagttctggaataaaaataactattatacataggtattttaatttaatattggctgtagatttttctccaagtagtgtggcaaaatactcaaataccacttaattcaaaatagttaacctccaaaaggattcaaagatcaacttctgacaacttaattaaatataactgagactcatttggctttctgttatactcccaaaatgtgaaaaacaaaaataaacactgacaaaataaatacagccaagctatgaagagttacagaatatggatttcagaatcaggcttttgggttctggcacatacttgtcctatgcctcagtttcctcactggaaaaacagaagggataatagcacccatcccaagggcagaggcataaatcaaggtaaagcattgcctgtaatgcctagatagcagggacagttcaggagaatcaggttggtgatttcatttgtaaattccctgccatttccttaatctcacaactgtcagctgaggacaatgcagaagcaggaacatactttggtcatcaatgaaaaataaaatctactatgaaaaaataaaatctattgtaaaagaaaataacccagaattaaaaatacacccaaggtaagtagtctatgcaggaatctgattactggcctatttgaaaaagcctttccccaaatatttttgttcatatatttaatgtcttctgttagcattcccattaatccaagaagttaaactatatcaggtaactttcctctcagttcactgggtttggaagtgggacagcgaattgctgagaaattgatagctgaatagctgggcaattcaaaaaatcattataatcctgttttgcaaccaaatagggagcaagtaaataagggatgatagcaactacgatttgtatagcacaaattatatggcaggcactattttatataatttctctcttatacattattttacatttgaaacctctacatatcctgtgaggtacttgtattatccccatttaacagatcagaaaattgaggctcacagtggttatattttttcgcccaaagtcacagtaagtggcaaaaccagaaaatgaatctggttgtttttgtttccaaagcccttaaatagtttt

SEQ ID NO: 39 - DNA, 100545 bp, Homo sapiens
ggaagatcacttgagaccaggagttcgaggctgcagtgagctatgatcatgccactgcactccagcctgggtaacagagtgagaccctgtctctgtaagaaaaacaaaatggctgggcatgctggctcatgcctgtaatcccagcacttttggaggatggtgcagaaggactgcttgaggccaggagttcaagaccagcctgggcaacatagtgagagcctatcactattaaaataaaaacaaattagccgggtgtggtggcatgtgcctgcagtcctcaaatttattgggaagctaaggtgggaggagctatgatcacgccagtctcttaaaaacaaaagagtacttggtccaggtgaaaagaaaatatagtagaaaagcttaagccaaaacaataaaatgagagcaagatgattttctttattgctagtgtatagcctctatttagagatggttgagacaaggtgaagtctccttgtttctgcactgttatcaactggtcttatatgtcacacaagaaacttggattttaccatgactgcaatggatgatcactgaatgacttagagtatgacttgagcaaacatgcatttttaaaacatcactctgccaagctggaatggagaagggtagagaagcatcaagaagactatttgatttatctgagtaatttacttgaggaaaaaatgagggtatggggatcaagttgagagtaaagcagtagaagacagtgctctgagcaaatggatatggaatataaaggaaaagaagttatcctaagacttaggtgaccttgtattcttgtttgcatacgatggttctgattatacctaatctcttgtagtagttattaccaaagctccattttactctctaaacagcctgtttggactatacattacaggttgagtattccttatccacaatgctttggagcagaagtgtttcagattttggattgttttggattttggaatatcggcatatacataatgagatatcttggggacagggcccaagtctaaacatgaaattcatttatgtttcatatacatcatacacacacagcctaaagataattttatatagtatctttaataattttgtgcatgaaataaagttttgattgcattttaattgcaacctgtcaggaagtcaggtatggaattttccgcttgtggcacaacactggtgctaaaaaagtttctaattttagaacattttctattttgggtttctgattagggatgctcaacctgtatattaattgctttaccattaacattcagctgtctggcttggcctttagataagattagtagtgaagccagaggatcagattgtgggtggtaagggagtaatcaggaataagataagttccatttatacttgtttggtttaaggtgcaaagtaatctggtgataaaaataaataggagcatccttattctacaggtagaaactgaaaatatgggtagatgaagtaacctaggtagaatacatagcataagaagagatgaagaaaagaaccttgggaatagaaatatttaagagaggaaaagagaaggaagaccccataagaagaaagagaaggtcagaaatatatgccggtgaaagtgatcctatagaagccaaaggaagtttcaacaaaagtgagatgattagtgtaaaatatttcagagaagtcactatttaaaagaaaacatcgtttgctcttacaaagtctatcacataaaatggactaaatggacacatatttatcatgtctaccagcacatcattcttatcctcctccagtcaacttcaaatatactccagaagatagaaaataaatattattgttattatttgaggcagggtctcactgtcacccaggctggagtgcagtggcacgatcttggctcactgcaacctccacctcccaggctcaagcgattctcctacctcagcctcccgaatagctgggactatagatgtgctgccaccatgccaggctaaggttttgtattttttgtagagacagaatttcaggcttcaccatgttgcccaggctggtcttgaaatcctgagctcaagtgatctgtccacctcagcctcccaaagcactgggattacaggcatgagccaccgtgactggccaaaataaatattaatttttaaaaatcaatttctcctgttttcctgtcttaatgctttaagttcattttaaaaaatatctttcaacaaatgtactgctaaactggattcaattaaaatcctcaactaactgtatttcctccttttcacgttactttaatgggttattaaagacaagaaaagtcgctgtcaagattttttgtttttgtaaaaggcaatttccagggctgcataatatggtcagtacagtcaatcaaaactttgatactctgtagagctaacacaagagagtaacaagcagcagctaaggcaccataagatcctgaatcacataagatgattaagttcaaaacttaaatactgaaacagtgaagtatacttacactatttagatagataagttaacaaggattgaaactaaaatgatctattttctagattctatacaatgagaaaaaaaaaagtcttacttagaaaaaggaccaatgttgaaataaagcgtgaaagaaaaaagaaaattctatcccagattagaattcttcaaaattaagtcttatatactaaaaactactaaactatacactttaaatgggtggattttattgcatgtgaattatatctcaaaaaagctgttaaaaaaactaagttgtatacaacacaaaaccttaagcttctttaaaaactatgtttaaacacacatgtcataaagtttaccatcttagacactttttttttttttttgagacgaaatctcactctgtcacctaggctggagtacagtggaatgatctcggctcattgcaacctctgcctcccaggttcaagcgattctcctgcctcagcctcccgagtagctgggactacaggcatgcgccaccatgcccggctaatttttgtatttttagtagagatgaggtttcaccatgttggccaggctggtcttgaactcctgaccttgtgatctgcctgccttggcctcccaaagtgctgggactttaaatgtacagttgagtggtattaaaaacattcatattgttgtgcaatcatcaccattaccatccacatccagaactctcttcatcttgcaaaaccaaaaactctgtacccattaagcaataactttccattccttcctccccttaatttccggcaaccactaaacttaaaacttttaagtgtttagtataatgtgaaattcttaccagattatgtataatatttgttaaagtccaagcaacaggaacactgaagaagggaatgctgagtaagacaatatgaagcaagccaactcccaatgcatatgtcagccacataccccggctgttcatgacacgggtatttggattcacttcactgtgggcaactccaacgttcatgtttgctctgtaggaagtaatgaaatgaatcaacactgatacaactggcaacctaacacccccaattctgacatgacaaggtacctgtgttgcgaggattattttttcctagttactttgaagtagcacacaaacaccatccaaaatatgctacttgtagatgctgatgacagcagtaaagaatcttcagcatttgactttagggtaagacaagacttgttattatggttctatttgaaaaaatagttacaatgcctttccaaaagtttgttttctagcatgttgttttactgaataggaaaattcaaactgaaagagaaaacctacattttcttatatcatgagagcaaagtgaaaagccaaaagctaaatttaccaacataataaatttatattaaaaagaaaaagcagaactcaccgagccagtgtgtcaagtagtcagactcttatatttgacttaatgtatccataaagaatggtcagagttcagatcacttctttctgaatactcaatgtggaaggtacatgctgttgacataatgtggtgtaaaatttacatggtcaagggataatgtttgtttctcaattttgtgattaaactaggtgaaaataaggagtcttctgaatatttctctagtcaaatcaaaaacttcagttttctttcttctttttaaaaaaggttttcccttctcctttccattgaagatggactccaaaggaagaattgataatagttctcagttcttttaatgatggtgtttacttgagactaagaattgcttaaaataaaactgtcctgaagaacacctatcatccgacggagggggaaaacgaggctagattatatttggaacagctgtgattttaaaatacacaaacgcttgtattacggagttagcatacagagaggaatttctcataaccccttccagcaaatgtttccggagtataatgctccttccgctctagagacccatagaacaggcatcaagggttaaggggacgaaaagttagttacactaagaccgctaaagcctccaatttatatgtgtaaatctttcgtctaaacacccatgatttatcatacattaaactattatgtcatacttagaacatgccaacactcaagatagttttcccacgttccacaggatggaggcctgaaatttacatctcagctggaaggcaaagctggtgcggtactcatcctattccaaccagaaaaccttttcccagcaggtttgccgcgctgcccacgactggcaaacaatgaccttacagaccgtgaagaggctgttggctctgccctcgccggtgcctccgaagacggcgacccgcagcggcccctcaggggagtcccccctgctagaccgacagcccgagcgctctgggccagagaaaactcagcaaaagccgccgctgctaccacctcagcgcctcccccaacccgccccttccttctcgcggccgcacgtcacgtcaggaccctggcaagacaacgaggatttgcgtagggggcgagcctctgaggccacttggctcttacggccacgcagggcgccgcagatgcagccggagcccgcttttccctctcaggacgacccctaggccgccagcagttccctaccgacgaaggcgactgtacagcgtccaccgcgttcgtgcccacttacccgccgccccactccgggccgccggctcgcagcaggaccagcccggctgctacggccgcggatacacgccctcaggcccggcgctgcgcagcttgcggaagctttcccggacagactcgctgccagcggattggctgcgagcagcgccaatctcacgttgcccccgggcgaggcgggactcagtgccgcgctctctgcacccgctctgccgcgcgcgtgcgtgctgggtgcgggtgcgggtgcggggttgggcctgcgcatcgggtgagacgctggctgcttgcggctagtggatggtaattgcctgcctcgcgctagcaggaaggtagtgtggtgtgactaacgggtatttattatatcctcgatggctcgagggccccgtcccctctactcgtcctggtccgggcgcgaacgctatagggcagctaagggcgctccccgcggggcgggaagcgaagccgggcttgcgggcgcgcacacgtggaacgcgttttctgagcaggtctgggctccggggtgttctggcttggtctttgttgcgtcccattccccagacccttctgggtggaggacttaaaatttgttttccaggcagcagatttaacccatggcaactgtaactcatcttgtgtgagtggcggtttatagtattgtatcctgtggcatcatacaaggggtgcaagttaaactctttaaagttaatcacgatttttgctcttggccttctgggtttatccgtacgccgaagacaggcacctgtattacatgctaaggaaatgtgaataccaaaaattgatcctgaggaaagtcttgattaggtttttttggaatcgcctttgaaatgtaatttccctcaccttggcagtgcagaaagtttgtgatttttattgccgaaatagctttcaacattttgaaattgacttaagagaatgttggctgtgtatgtctgtatcttgcatttctgttggctttgtgaacctaattgttttggatttagtctgatctttaaataaatgatttctttgtgttctctctaatggaagtctgtgagttctctgatctttacttcttttttaggcacacctgttgtccttaactgactttccgggtcatcagcacttcttcagaagtgttccttttccctcccagcaaatatggaagactgactatcctgatattcccagacattctttgctgtgatttgtaagcccgatataaacccttccatttggtacacatatggtatagagtgctatattccaggggctatgctagcgatgtgtgattgatataaaacccctgtcctcaaagaactctgagtcaggagcaacagacagaaacacatattaatagagtaacttgtgatgaggttaattagaaatgaggtaaagggggactgcaggggaaggaatacctaatctgttggcaggtgaaggaaaggaggctgcagcagggaagaaaggcttgaagagttgatactgaactaaatctggaaggatgattagaagtcagctgagagagaaccatgtgagctgaggaaggagtgagtgtcaccatgttaagagagacaagttggctgggcacggtggctcacacctgtaatcccagcactttgggaggccaaggcgggcggatcacctgaggtcaggagttcgagaccagcctggccaacatggtgaaaccctgtctctactaaaaatacgaaaattagccgggcgtggtagtgcgctcctgtaatcccagctacttgcagggctgggacaggagaattgcttgaacctgggaggcagaggttgcagtgagccaaaatcgctgcactctggcctgggcaacaaagtgagaccctgtcacaaaaaataaaaaataaaaaaagacgagctgtgcagtatgatcgccctagagcacatttgggcaacgatgggatgactgggagaggaggcaaaaatccagttgttaagaagtttgtacttaacctggttggcaattggaaacctttataaaaattttaagtggggcagcaacatgatgaaatttaaatacagaaagaaccctataggtggttgagattcgagtcaaaatatcaattaggtggttattgcagtagttcaggagagaaaggccgaatggaggcagtacaaagaggagaggactagtttgggaaacatttagatagtaggagagagatgactgggtggcaggatgtagagagcgagtagaatttctaggatgacttcaaggtttctaattttgctttatgtgcttggatggaaggtgtttgagagcatggcctttggagtcaaacatgccaaggtgtgcatctgccacttaatagttttgtgatcttgagcaagttaccatgcctttaaatcctatttggtgataaaggatgatagaatacgtagagttgttgtgaggattaaataggataatatatataaaattctcatgttggctattacttttattatcaaacaagaaatataggaagaaagttgattagaggccagtcgtggtggctcacgcctgtaatcccagcactttgggaggccgaggcgggcggatcacctgaggtcaggagtttgagaccagcctggccaacatggtgaaaccttggctctactaaaaatacaaaaaattagccaggtgtggtggcgggcacctgtaatcccagctactcgggaggctgaggcaggagaatcgcttgaacccgggaggtggaggctgcagtgagcggagattgtgccattgcatttcagcctgggcaacaagagcgaaacctgaaactctgtctcaaaaaaaagaaagagaaagattctctgatcagtttgggacatgttatgtttaggttgccttcaggtcatctaaatgatgatatttagaaggtagatggaagtaaggccctaaagtccagaaaaaaagtgtgagatacaggtgagctggaggatggtgtggaagccaattgaaattatgtatataaagggaaggaggatactttttctaatgtttgcgttagcataagaaagatgctgataaattatatttagtggtccttcattaatattcatgaagtgaagggcttgccatgggtgaagcatttgattgttctgcctggcatccagagatacataatacataatttcctacattcaaaagttgtacagcaggaaaaaaaaagttttacagttcaggacaaagatgtagtaggtttaattatacaatttaattaatttaatctttacagttatcttacattgattataggacaaaatgatatttgatattttgaatatattagattatccaaatacgtaattaagattaacttcacttttttattttttttttagcttttttaatgtgagtactagaaaattttaaatgatgtatgtacattatagttctgttgaacagtgctggatagagtactggttaaaatggcaggctctgaaatcacgctactttggttttatcctagctcttactaacagctatatgatactgaggaaattaaactttctaaaactcaatcagctaatctataaaatggagacaatacagatatcatatgcttatgaatttggtagagacacaaatattcagactgtagcaattaggagagaagaaagatgacatgacatggaagaagagtatgaaaagagatgcagacatcttaagaccagaggatgcaatgggatggggtagataaagtgtgacagaattcatgctatgaattgccatgatcttagtaaactagaagaatgaggaatattgggatgcaattatagagatttaaaaaaaaaagatcttggatttggcattgtaggagatgaggtattataggaaacgagacaaagatgatgagattaagactgctcagaaggagtcagtctaagtttataccccaaagttttgttgatcagtgtttttcttagatccttgggatttcctagctgaggtggaagacttcttgaacccaggcctaatgtgtgagcccctttggggtaggggttagaggtggggggattgttcatttaggggtttagaggagctcagtttagtcccagtatcctgggatgtttttagcacttatatgccaaacactgtaatacattatttatatatactactttatttacttctcaccacaatcatatgatatcattattagatccattttatagattaggtgattgcattttagagagtttaatttcctcagtgttacatatctgttagtgtaagagctaggataaaaccaaagtagtgtgatttcagagcctgccattttaaccactgctctatccagcactgttcaatggaactataagccacatctatcattttaaattttctagtagtcacattaaacagattttttaaaaggttagttttaataatatattttatgtaatctagtgtatccaaataggataaaatcatttcatcctataatcaatgtaaaaaattgatatgatttttattaatgctgagttggaaattgagtgtgtattagcacatctcaatttggactacccacgtttctagtgctctagtgttcagtaagctacatatgactgatggctaccatattggacagtgcagatctgtcccttagatcgaggtaattctgaagctttggaaaagtgcagaggtgccttttgcttgtgacagcactaatttgtgtgaatgttatgatgatggagtagcctatagtccactgtttccctgcttgattgggacaggaaagcctcccagctgttgagaacaacaaaaacaactattgaaaggtagttgttcacagctgctctcctgagaactgggtaccccaaaactaaatcaaatatatagattaattagagggtagttagtatttaaaaagaattctcagcattcctttacataatgatctcttattataatactctacattttataaggccttatcatttgtagaacaacactttatatattcttccttatttgattcttcacagtaaaccagtgaggtattagctccatctttacagatgatgaattgatttatggagggatttgagtgatttgctccatttttatagatgacaaattgatttatggagggatttcagtgatttgctgagtttatgtgtaataaaggtgaacccccaatacctattttataggctctggtctgttacatttttttcattgtgccaatcacctttgccttctatatagcaaaatatactgtatttatgaactgtgatcagttaacactctcagaacccaatatgtcggcctcttcccagaagtgcattccttaaactcctgtgtaattgttatagtgcctgtactccatttcctactcaattactgagtctttctttacatgtctttgtcttatgctgcctgagaaataatcctaaactgatgactttttgttgtgtttgttttcggtgttgctattttatttgcacctagattgcataggattaaatcatcataggagcatgtaactagtcatgggaaacaaagtaccttgagtccacccccagcccccattttttttggtccaataaaatcttgattctgcagaggaattgcatgttgtcaagcttgtgcttattttcctgtaatcttttctgaaattaggcaataagatgcaaaaagcacccccctccctgcatgctttacagatggaatttccataggacgtttttggatttttcgtttgtttgaacaaaggatttccagttaccaacagagattttggatctgcaggttggatctataaaggacctcaaatgccaacttagagatttgagctttatattattggctttgaggagccacatgattaaaataatgtcgtaggcagaataatatagaggatagttatctgacatgtctggtatgagaccagttcagattaacagtaatcctaactctaaaggagctcagtgattgaaaaagacattataattcatcagaatgtatggatgactaatgatgtttaaatgagactgttggtaaggcacataactgattgtcattatccacttcccaaagttatattatcacttggtcattctcagccaacattacactcattatagcacaattgttcttatcattattcagttattaccatagcatttgtttttaagaaatctttttagaacatgcatgtcttgattccagtatctgtgagctttcggtgatctactgtaatgagtttggaccaagatgtagttggcacagacatttaaggaaatatatttgaaataaaaatctcaaaagtacctgggcccagttacttactcagctttcagcctcttaaatgtccataataataagtataatgttttattcatagtacctactttctatggtttagcggtttaaatgcaatcctatatgtaaagtgtttagcatactatatatttaatgtagtagttgctgttcttattgtaatcatcattttaataaacggcagtatagactgggtgaccaaaggtgaagagtcattgaggctaattaggaaattatattgggaactaaatgtgagaaatactgagaaaagaattgataggatttaggagttgattagatttgagtcagggtgaatggataattcctgtaggaaagttgtgggtttagggtagggattggtaattatacccggagtttgagctagtgattatttcagcaggcagttggaaatacagagttcgagtttgcaagaaaagtcagaatataattagtcacacaaaatcctggaagaaattagaaaaaaagcaatttcttcctctaatgttattgtggactttttttttttaggtgcttgtggcagaatattgtggattttttgaacccatttttggttatttttattcataggcatttatatgtattcatatattaggtatcaatagaggaattgttgaaggacttgccttagctctgcctcttaataactggatgaccttggacaagttttctaatttctttatgccttagtagttttataaaattgaggtgataatggcacctattttcatagggtaataataagaaatagaagacttatggctgggcgtggtggctcacgcctgtaatctcagtactttgggaggccaaggcaggcggatcagttggggtcaggagtttgagaccagcctgaccaacttggcaaaaccccatttctactaaaaatgtaaaaattagccaggtgtcctggtgggcacctgtaatcccagctactctggaggctggggcaggggtggctgaacctgggaggcagaggttgcagtgagtcgagatcacgccactgcactccagcctgggtgacagcgagatttcatctccaaaaaaaaaaaaagaagaaatagaagacttaatattgtatgtgctaacagttgagcgtagcatacagtaagtctcagtgaagatgatctattttcatctgtcattattattgccatttgtcctgttggtcaggaatgcttaacaattcttacaagttgcatttttatcttctagctgctctgttaaaagcgaaaatgaaacaattgcctgcggcaacagttcgactcctttcaagttctcagatcatcacttcggtggtcagtgttgtaaaagagcttattgaaaactccttggatgctggtgccacaagcgtagatgttaaactggtgagtgtccttgagaacccaaatacctttaagacaaagaaaagggtctggacacatgttttctccttaaactgttacctttattttatttctttacaccaataaattattcttaggacattggaccctttgtcttaagagtaaatccttaaaaataaattttaatttaaattaacattatagtaacactaaaggaaatataaaagaaaacatgttctttaggtctccatcacctaagacatctaatgtttgtattttctacaaatattggttattcatatttccttgttttagggatttacttttgcattttattttttccatctaatctaatttcaaaccatttcccttgttacttttttcacattttaaaatttaagtgctgtatattaaatcatttgagtaaatatggcctatatcactcattatgatttattgcaattagtttccatgactagttcccctgttctaaattgctaacacatagagatatggtctattttattcatttttgtgtcctctgtacctggctagtacctagtatgcactaggaaggtaaataaatctgattgaatgtaagaatacattttttaaaatctcttaattatcagatatttatgctatttctagtgttatagaactagaaacaatgctgatagaaatatatttgtaggaaagggacctaactttttcttatctaccagataagattctatgagataaacatgtatatatatatggacacaaatatatatatatatatatatatatatatatatgtaaaataaaatcccttctataaatcacttctcataaaacactgtgacttaactactactatacccattttattttttatttatttatttatttattttttatttttttgaggcagagtctcgctttttcgcccaggctggagtgcaatggcgcgatctcagcttactgcactctccctccccggttcatgcaattctcctgccccagcctcctgaatagctgggattacaggcacctgttaccacgcctggcaaatttttgtatttttagtagagatggggtttcgccatgtcggccagtctggtcttgaactcctgacctcaggtgatccgcccacctcggcctcccaaagtgttgggattacaggcgtgagccactcatgcccagccatactatacccattttacagataatgttctgagaagtttcccaaagtctcataattagtaagtagtggagctaagactagaatccaggtctttctgactcttaaaacccattcttgatcttctctctgtgccagtggttctcatgatgtttgggtgcatcagaataacttaggatgtttgttaaaactgttactgggtcttactcatacaacttcatagtctagatggggcctgagaatttgcatttctagtaaatttctaattgatgctgatgctggtgggttatggaacacactttgagaaccattcttctatatcaaacctctgttctgttttgaatacactataagctttataaacgagaaaacaagtatattaaattatacccaaagaaagacaatttgtttttcttaggcatttcatatagtcagttcagtctgattagagtataattgataataattaaacaggattagatagttatatctgacagacttcacttaagaatctttggcaggcagacatctttttcttaaacatttctggaagaaaaactggtttttaaaacagtgttacaaagccaacagaagtcctgtataaactaagttaaatattttaatctggctgtaaattttagtctcttgacatttaccagtatttgctttgtagaattttaagatatacaccttaaatgtgtggctctacatgataagacctgtttcattatggttttatgctataatagctatcctgactagatatgttttcataattaattaaacgtgatggtactattttgaacatttaaacaaatctttgtgttcttattacgggatttcgagaccatgttgcccaggctggtctcgaactgctgacctcaagtgatccacccatctcagcctcgtaaattgctgggagtacaggcgtgagccaccatacttggcctgatttttctttaaaatatagaagaccgacagttcccagaatgtaaacttaactttattcatttatttatttattttgagacagtctcattctgttgcccattctgaagtgcagtggtgcgatctcagctcactgtaacctccgtctcccggtctcaagcgattctcctgcctcagcctcccaagtagctgggattacaggtgtgtgccaccatgcccggctaattttttgtatttttagtagtgaccgaggtttcaccatgttgaccaggctggtctcaaactcctgacctctaatgatctgcctgccttggcctcccaaagtgctgcaattacttgcatgagccactgtgcccagccaaactgaattttagattgagagaggtgtgaggaacaaaatcttaggcatctctctccaatgttttgtatatctaatttatctaaaaattgccgacatatacagtattatatcattttaggttattaaaaagatgtgattttattttaaataccagagtcagtataattatagaaagattttatttccccctttgtaacttgcatctgtggtcatacacataagactttgtggagtaaagtcagacttatttattatggaagttggctgccaaatttagaatatggtgttcatagaaagtatgatcactatgggaatttaaattttgtttttgttatatatgtatatttttagtataagaatataaaactaagctatgaattgagattttgaaaagattttcatctgatatgatggctcacacctgtaattccagcactttgggaagctgaggcaggaggatcgcttggagccaggagtttgataccagcctggacaacaaagtgagaccccacctgtacaaaaaataaaaataaaaatagttaggcactgtggcatgcagctatagtcccagcacctcaagaggctgaggtgggaggatcacaagcccaggcattcaaggctacagtgagctgtgatcatgccactgtactgtatgtagcctgagtgacaaagtatctaaaaaaagtcttgattttttttcaaattaaaaacttactgtggttgctaaattagatgtgttttctcagcagtttcctgttagatggctgtttgcagaaaaagatttagaaagttataatgtagtaaacatagatttttatgtaagggagaaagtattaaatattaggttgattcctgccatagaaaagcaaaataagaaaacaaaaaacaaaataaataaataaaaatcaggttgaataatgatacttgctaggttctgcctgactagaacatgtgttactttgtcgctgatggagttctgttctgttctgttttgttttggggccatgcataccaaaggtgtatgtaattcagaagaatttttttagtcaaatttaaacataaattattgtttattgtaaatacccatgataatgaaacagtgaaaagcaaccttaaagatcagcctaacctccttattcaacagttgaatctgtgtccagagaaaacaagggagttgcctgttgcaccataactagaaattagtagagctgaagaatttaaactcttatatccataatgctatgcttccataaaagtaaataaatgtcaaaattctttcacttgtgtttctttctaagtgtgataacagtttaatatttttacatattaaaagtgttttttgacattttataggagaactatggatttgataaaattgaggtgcgagataacggggagggtatcaaggctgttgatgcacctgtaatggcaatgaagtactacacctcaaaaataaatagtcatgaagatcttgaaaatttgacaacttacggttttcgtggagaagccttggggtcaatttgttgtatagctgaggtaaggtaattatattggttattttagtgatttcatattcactgaacattacagttaaaactaacccagtatttggtgaagtatggttttaattatttttattatggtaaaatatacataacataagccgggcgaggtggctcacgcctgtaatcccagcactttgggaggctgaggcaggtggatcacctgaggtcaggagttcgagactagcctggccaacatggtgaaaccccgtctctactaaaaatacaaaattagctgggtatggtgcctcacgtctgtagtcccagctacttgagaggctgaggcaggagaattgcttgaacccgggaaacagaggctgcagtgacccgagatcatgccactgcactcccacctaggcaagatagagtgagattctgtctcaaaaaaatatatatatacataacataaaatgtatcattttaattatttttaaatgtacaattcagtggcagtggcattagctacagtcacattgtcgtgtatctataaccattattcatctccgcaaccttttcattatttcaaactctgtacccattaaacaataatgccttttccccccatcccctagtactcactgttctactttctgtctctatgaattagactattctaggtatcacatataagtggactcataaaatatttgttcttttgtatctggcctatttctcttataatgtcttcagggttcatccatgttgtaacatgcatcagaatttccttcctttttaaggctgaataatattccatcatgtgtatataccacattttgtttatctgttcattttcatcggtggacacctgggttactttcacccacctttgggctattgtgaataatgtttctgtgaacattggtgtacaaatacctgtttgagtccctgcttttacttctttggggtatatatccagaagtagacttgctatgtcatatcataattctgtgtctaattttttgaggagcagcaaagtgtgttttgcatttaaaaattgtattaagaaaattaagcagatatttaactatagcacttctcagagcctttactatattcaagcacattgtaaatctctaaggttggtggtttatatacgcactttttcctatacctacttgaccatgaaattcttttattgagaaagcatatcatttttgtttgtttgtttgcttgttctgtggactacactttagaaataccactctaaccggtacagttagtgagattacgctctagagatgtgaattgacttggtctaaaccttaactagttaagggcagattggatttaagaactttactcttctgactgtgagttaggtgctcagtgtctatgaactcctgagttcagtgcttggcacattcacttgcatagtaccaattatactacgctgcctctgccccagatcttataactagtttgtagcaaagcccgtctagaaccttgatctcttcatttctgttatctcagttgtgtttgatcacgtgactctgtactactttttttgtactatactattaccctgtggatgttgggctcttattgtgtgacagtatctatgtgccaggtgacagggtgattgtgagggtctcttgagttattgaaatttgcccagtagccatgtaatccttcatttgtgcttaggctggcagaccctatttaggcaagaatgttccagtacagtaaaatgataggacttcatacttgttgttctggaaaagtggcacagaaatgagatactgttgctgtctccccttctggtctttggacatctgtttagtagtccagtcttgccaagaataatgatatattctctaggttcattgtggtcttccctcagcccttctgtttttgaagtgctggcataggatagtgtaggttttctccattttttgtggctaggattccagctcagtacagatactccttgacttatgaggggattacattcctgattaaacctttgtaagttgaaaatattgtaaatcgaaaatgcatttaatatgcttaacttgctgagcattacagcttagcctaacctactttaaacatgctcagaacacttacattggtctacagttgggcaaaattatctggcaacatagtacactggagaggatctgttgtttatcctcatcgtcacatggctgactgggagctgtgggtcactgcctcagcattgctagcttatccactgctttctactgaatgcatatcacttccgcgccactgtaaagtcgaaaaatcctaagtagcaccgttgttaaattggtgaccctctgggttcagttttttacttttgggcttttctggctgtgtaacatgtcttaagtaggccagagaaattgcaaaggagatgaagtttaagtgggagattttgctgttggagcatagaggactagggggccttgcttattagaatccagatgtttagagatcattaaagggaaattgtcatgtgtactcttaaaaccgctgtccaaaatctagcacactgtgtacttctctattttcctcagcactcgctttatttggagttcacagagccttcaaatagattttggggaagagggactagagggttcaattgggcattgtccgtttttctcctcaagactataaatgggaatccacaaccctggatcttgtacaaagagtttgtctttaaaattgcacgaggtttgcatcagggaacctctgaatctgccagtactatttagctgtcagtgactactctagaagtcatttttttttttctgttttagagcataagtatttgatttttttttttttttttttttagctgttgttcaaacttgacagataggctttaagctttatttggtagattatcaaaaagataatttggcatttctgtattttctgcaagatatatatgtaacccttcagagctgaaattagtcataattagctttgcctactaggtggcagcactatacttggtttttagaaataggtttcacatgagctgtatgatttattcaaatcttcactgtagttctgagtttagatggcagttttgtaagtctttctccattggtcactttctatcttgtttccttatttgattacttaaacccacttgataggcaagtttatcattttgtctttgttttattttgaggcactcaagtggccttgagtataaataaaataattttgctcatcagaattacaaaagaattgtcaaagtatcacaatagtggaaaactataaagtttttaaaaaaatgtttgcaatgccaagcatttatcttagaaaatattaacagtattttatggagtttcctttcttacaagtctttgggaaaaccacatatagatgtgtgtgtgtatgcatgcacacacacacctacactaacaacacaatgaatttttacatatgtatactcctgatcaagatttagaccattatcagaaccccagaaggttccctcatacccactcccagtcagtacttctcaaaggtaactgctattcagacctctgtcaacacagattagttctttatgttcttgaacttgatataaatgaaatcatatggtatgtattattttggcacagagtttttgatgatgatttaggtttgattgtacctgaaaactaaaggaaatacagagctagctggaaggaacttttatagtagtaggggaccctagtacaccatctagatcccccacttcaggactgagcagtcagcccccagctgccaagagtgttggtgactcacccctgagtctccatctggagcttgcccttaccgcagctgaagacagctgccttacccaagtcatgcagggcaacctgcatccaatgaatccagtgactggttgaggtgttataaacgtcccagttcaggacaacattgccctatgcccactggtgatcatcccaaagaaccccccaataaactgactgctcactaatctccatctcagaatgagcttcatggattagccagcctacaatgtaggtcttctgtgcttcagtttcttcatagtactgatgaggaaactgaggtcttttgaagccaaatgccaagtcttcttacccaacttcaaaacactgtctctaataactcaagtaatgttcattgtctacgcatgcagggtgctgcactaggtagttgatttcagaggaattgtacacagtgaaatatgaaatttgtaacctattcaggtatacatagtgtgttcaaggcaaagcccagaattcagtcctaatttcatgcctttcagtaatgtattttccgtggtaggttatattacctctttactagcatgattagaaatgtatttataaagtttaaaaatacttccatattaaatattaaattatttacaaatatacccaggcctgcagtgctaagttcaatagataagttgttaggagtaggtgagttgaaacttatatgtgaggactgtgaatagtatttgagaaaaacaggaagtaatgtatgtttgttgaagtcagttacatttaaaaataaatatttttaaataagacttaatgggtgcattttgggggaaaggagttcactttttaatcttaaggaatattccttagcactcagaaagaattgaggtttcatatatagaaaaaatatattttcaagactagcttattttgaaactttttagatgaaaattacagtgaatgcaataaaaattagtaatttggttattttatctaccaaactaactgatgcatataattttaaagtcatagagttgtaaaccatcctaggctcagtggatcgatatgtaattgggcacactattaaacagccatcacctataactctagttgttgacattattttctgtttatttaaaaaatgttattaagaagaaaaattaagttagactttcagcaaaattggctggagaaatctaaaatacatctaattctttgttctttatttatatacttgaatggtcagttttcctaatttgtcaattataaaataacttccaaccttaaacagtccaaagaagtaaagcattatttttgttttgttttgttttataatttttataattttttgtagagatagggtctcactctcttgttcaggctgggctcaaaatcctggcctcaagcaatcttcctgcttcagccacccgaattgctggcaggcaggagccactgtgccctgcaggcattctttttatatctgcagagtaaactattggtattttaaaatggaattattgctttcatgatctgtgatgagtatatcagcaactgacacaaatttactcgtaatggttttctttaaaatcataacagcaagcataacttcttgaaatttattgtttgtagagcaataattttgagaaatttgtcatcttcaatgtttaattactagtactaattactaagcacagtgactgggttgaaatagagagagtgaaaatcctgtcttgaccgtctcataaaaatttttataaagattgtgtatattattcctatcacataataaaaaacacaaaatatttttctttttaggttgatattttatatgtgttatcaaagaaatgtttaagaaactaacaacatttttgaactggattttacatggaggctggttttagaaatacagaacagtttattttattttattttttttcttaaagaacaaattctgaagtaggagtcagaagcctaattctaaatcctgagtgtttgaataagagacctggccaaaggccaaagtcagattaagttttctgagaattttttttttttcatttatcaagtgagggtcaaatacaataatacatcttacagtgtcttgaatattgtgtacatacagatgcaagttatttctactttggacttgtatgtgaaaagtagtatgcatctggataagatcattagacttgcttattcccctctgcaaatagtatttcacctccgcattctatgtatgctattccacattttggggaaatcctttctaaaatgtaatagccattcataggtaaattccttctaattctcaccaaatgtcttcatcccgtagtgttagttcatttttttctctcgtttttccctcagaagaataaatgtcatcctctgcataacatttacatttattgattcattcatccaccatttaaatggttacagtgtactgaatattattctcaccttatcaagctcattatgcagttgacccttgaacatcacccagttgaccccaccacttcgctatgcagtcaaaaattcacatgtaacttttgactcctttaaaacttaactactgttgaccggcctcctgttgaccggaagataacatattttgtatgttgcatgtattatatactgtattcttataataaactagtgaaaagaatgttattaagaaaattataagagaaaataaatatgtttgctattcattaagtggaagctgttcattaagtgttcatgttgagtaggctaaggaaagggtagaagagaagagattggtcttgctgtctctggtggcagaaaatctgtgtgttaagtggacctgcacagttcagacttgtgttgtggaagggtcaactgtacataattttgtgatgagataatataggatctgtaggtttgtttttgtatcacctcacattaagcctccagggcttagaggagcagaatgagaagctgagtcattttgttttgaagatggaagttgggactcacttatttgtgggcccacatactataaaagggtcaggggaagcccctaatgtcattatgatggttctaaaccaaggacttctgactccttttccacagtgtagggttgtctcgtatattttttatagctgtgatggaggagctttagtcaaaatacgtctgggaagttttgaagcagttggaatattttacttcctaaatgcagcttcatcacaggtgatggaactctattgaaaggagaaaagccagggccaagatctccctgttgctaggctccccatagtgggtatctgggaacaagtcctgcagtcagagtactttaattagtgcacaatacttgcacaggcaggcaggcatactcacatgcagaaaagaaaacatttcagccattcaggcaaaagtctgtatttcacctgaatcgtaaagactgtgcgttttcaactcgtttttgtgtcagttttcatctaaaacttagcccccccaaaaactcaaaaggctttatcataattaccttaaatgaatttttgtcaagaggatttttacctgaattatcaggatatattctaagttttttctttactttttatctaaacattgaagaaaaactatgtttatctgaagtttaaatgcttttatgtaattttaattttgtaatgatactgcgatttcttgaaactcagtaaactggaccagagagtcagtttttaataactgataactaatatagcctccaaggtcctctaaggacttgtaaaacttttccttttaaaatactggttttctttatttcttctcttgacaccactaggttcactctctgccaccattcctcaatgtctctagtaagaatcaccagtaatagtgtgtactgttagagatgctcctgatggtggagttactgcaggctcaaatgctagctcctgcacagctaatgaattctgaacctgtgcccggtccaaaaaaaagtttcctgctccagacacagggtcatatgatgaaacaaactctcgaaatacaattccctttccttcctctgtggaacacactgtatttcataaatttatgaagtacacttatgtgtttgctttatgctttactgtctttagccatgaattgcaaagcatttcatatctaaatacgttttcgtagtattctacaaattgtaattttacaaaattttaatgttggaaaatagagggtttttttttactttaacataaatgttacattatgagcactaaggtcttattttgctttttagcacttcagtttcttcgtctagactggagtatatatgtttaaaggatgagcaaattaatatcttgtaagataaagtggttaaaacaaaatcccatgtaaccttataaagtattagcatcatcttcatcttatcatcacccttcccttaaagatgatctgtgtaatcatttattcaggaccatctagaagccactggcagggttagtcctggaactcagagttccagggccgcctttgctcagtgacaccaactttaggtcaggtggctagttctttggagtagagaaatagaattcagttgaccttagcattttggaaaatcagttggttaaatgtagaattgtcttcaaagggataattatggaataatgagccacagaaaagaaaatctctagcactttctgtcctctaaattacaccatttttgaaccatggaatgtattttggaagaggtagatcccttaagagtactcagaaactcccaactttgttttaggttctgcttttttgggggatagtatcacagtaatagcttgacatagcgcccctagtaagagtttcatagacttcattttcagagagaatctaacgtcctctgctggtactgtgagctggagaagccgtttctttttgttgctctgatattccctgcatgctaccaacatgttccacagagctgtaggccctacagtaaatctgcttggttagggcagggtgacagaaccttcaaatatagacccacttggattcagatgagttccaacagtggggttggattcttatggtgtctaaattatatagatttactttagaatattcagctcttcgtataaagatggccaagaaagattactcccaattttgggtcatcattggctcaccagacatgtgaggaggctaccttcttcccaatgctttccttgccagcatccccactccccactttttttttgttttttttctgacaatggcatattttactattgtactttcatacctacctcatggggtaagtaaatagaaagctgaggatgaagctagctcaaaagagggcagacacttcaaaatttgtgtttctatgactaacatctgaggaaatattttcatgctgaatgaaatgtcttcttcacttatgcttacatgttttaaatttttttaattaataaaaaatttagccttaatgagtttaaagctcagttttaagaaaaaaatctgtaaatatatatataatttaattttttttggaccataatcttgaaatacagaagtgcagttttacacataataaagaagggggagggaatgatcactttaccaaagaactattcatttaccaacaaatttatggaaatagtctgttaaaaagcaagttcccttaatacagttgaagtacttgcttttacagacataagtcatataatgcatataatacaaatggcatttcaggtatacttgtttgtgtacgagtgttttaataaagtgaaatactcaaaacagtaatttgcaacataaaaaaaatacaagctggcctgttgcttatttgtgtaactctaaggaatattacaaaagaactggtcacaaatgtttattaggtaaaatacgctattgagtaaatatattatgcaataatcatttcaaatctttgataatgaacccatcgcaatatctaaagtgttagttttattagatgtttttttcccccaggttttaattacaacaagaacggctgctgataattttagcacccagtatgttttagatggcagtggccacatactttctcagaaaccttcacatcttggtcaaggtaagaaagtagctttgtatacaaacattctttaccttttctgtcttaattgttggtttaaaaaaaaaaagttactcggtgaatacaaatatattgctttgggcttggtcctgataaaggctagttaacttccaagtaaacattcagcctttattctagccaccaatttcttaaatatttagaattgttctcaaaaggaactgtatgagagactggacacttccatggactagttactcctctgtaaaaactaagagtatttattttaccagtgctggattaccagtgtcatcttcatatatgaagaagattaaaattttattgaaacatataaaacataattgatttggtaatagtggaaataaacgataccatcaagatatgattaaataatttaaaatctatttgttaattgatggaaaacttcaaacatgcataagaagttactgtacttatcactcagtttcaataatttatcaattcattgctaaagttctttcatgtaataccctcgcccatttcttccctttctatattactttgaagcaaatacgtattgtttctacttgtaatgtagttagtgttttatatacttttatgtaatattattacattttaattgatatcttatgttttttattttattttattttattttcctgagacagggtctcactctgtcacacaggctggactgcagtggcatcatcttggttcactgcaacctctgcctcccaggctcaagtgatcctcccacctcagcctcctcagtagctgggactacaggtgcataccaccacacccggctaatttttgtatttttagtagagacagggttttgctgtgttgcccagctggcctcgaactcctgagcccaagcgatacacctgccttggcctcccagagtgctgagattacagatgtgagccactgtgttcagctgataagtgtttaaatttctctaaaaactatttacttataaaggtaaaaaagatctctttaggcttcagtttcacatatctcctttaatctttttttaataatttctagtgatgggatgattaagagactattaaagctattacctctttagagtcatgttcaaaataattattagatctgaaaagggacttgtgggttttgttgttgttgtttatccttctgcttctccaatttgtgttgtaaattcatgtttaattttgtgttccctcattgcagtttatcaaagtacattctgtatattttctgtggtttttttccttcagttttaatattaaattattggattctttttttcaaatgacttctgtcttcatttcatgtataaaatataaatttcttatattttaatactggtaccaaattctctcactcattcacttattttgtaaatccttagcttaattactgattacttttgcccattaggaattgatatttttgttccacataaaggagagagttaatagaaactcctaagacaatgcacattttttcctcatttattcagttaatgaaaatgagctcaagtctaacagctattttatttgatgtagaatgatacaaatattatatatgttttaattaaaaataatagattataattcttttactgtatatcaaaggttaggacagacagaaggcatttttaaaatatggctcctctctagaaatactctgaccccagttcttacgagttcaaattaggacaccattaggagatatttgagtggctatccagtagagtactttgaagtaatctagtcgccttataaaacttaaaggaatttatttttgtcttagtagtgaccagtctaatctggatggccaatggctttgcatcactcatacttctcatgcttttctttattcatctccatgggaactatgaaataacaatccttagatatggaatccatctgatctttgcccttttgctgttgattttccttttcctgctgacctcagtcttataccttaagtaagtgagaccaggtatgcatattaaggaatttctgtagtcaacaaatgaactttactttctttagtatatttcttttatctcaagaaacaagaataaatacttagaagatcagtagttgcaaaactactaattgcttttcataactcagttttttcacctaattatagttgattggttaggaaaacagcagaaagttaaagtcttaattttaagttgttcttggtggacatattatatatatctacaaacactttcaaaagccttttatgtttatattgccttagtgctgataggttttgagtgattgaatcacatactcatatttcaccagctgtcatttagcttccatttaaatattttctgcgtaagataaaattacagttcaaccatcctaatttatacctgtacatgtagggttcttggactaatttctgctgtgaggtgaacatccctgcttagcatttactcttcatgtcatctgatataatgatacctgtgggtggcataattgtaggtacgggaacaacttacaacataattttatttaggcattggaaaatttgttacccctttaaaaaacgtaatttattattattattcttattttgagacagagtcttactctgtcgcccaggctggagtgcagtggcgtgatctcagctcagtgcagcctccacctcccaggttcaaacagttcttgtgccttggcctcccaagtagctgggattgcaggtgtgtgtcaccacacctggcgaatttttgtgttttttttagtagagacagggttttgccgtgttggccaggctggtctcgaactcctgacctcaagaaatctgccctcctcagccccgcaaagtgctgggattataggcgtgagccactgtgcccagcctaaaagacatattttacaatgtttaaaaatagtttactagaaattccagctctggtttttctaggtgtatatttgttttatggattaattcagccatttaaaatgatttatgtgtttaacagtatgtcaccctaagttgcccttgccttctgttcacttccattttaaagcatttttttaaactaaaaagaaaaatagaaatacatctctatcttttaaattattgtaccaagaacatggagtaaattaatagctttagtcctatcattttctgtcatcacttctattccctttaccctagataatcagtattaagctttccaaattgatttaccctcctagtcagattcttttaagatcttccagtacttctgccttagaaatttctcatatatcaaaagtagtatttaaagggctgtgatcattttcctaccctgttactagagtttcagaacatcatgttctttgtaaattcctacggtgtgtgattgtgcgtgtattaaaagatcttttcatcttaatttaagaatggaccttttattccttaaatattttaagaaaactttctgatatattcaagcaaccatacctttacattaggaatataaatagctgccattataataaatggcataccatagggtcatgtaaaaatataacagggagcatattacaacactgcagtttaattctggtgtttgtaggatgtgctaaagttagagagctgaatgattttcttgtaaaacatgatagtataatggggcctcctccctattattggccaatattacttggtgcttttaaggaagcacatttctttttttttttttttttttttttttttgctttttgagacagggttcatttggaatcagaaaagacttttccataagtatgttttattcaaacatataattcttattaatctcaattggctgggcacagtggctcacgcctgtaatcccagcactttaggaggccaaggcaggcagatcttgaggtcaggagttcaagacctgcctggccaacaaggtgaaaccctgtctctcctaaaaatacaaaaaattagccaggcatgggggcgggcacctgtaatcccactgaggcaggagaattgcatgaacccaggaggcggaggttgcagtgagccgagattgtgccattgcactccagcctgggcaacaagagtgaaactccatctcaaaataatgataattctcattttactttcagaggatattttgaggtgctgaagcaataatttatcaatatacagattaggtataatgtggtcttagatacatatatttaaaaatcaacaggtatctctttttactttcatatacacatttatattttgccctcttgatttctgtcttccttctgtctagagctacagtgcatgccattatatttgtcatctaggaacttactgactagtggggaacacaggtgagtgaataatgacaaaatgaagccactgactgcctagagagaggttagcaagtttttcagaaaagatgacgtttgagtttgaagatggtaggagtttgaagatgatagataagaagacatggagtgtaacctttcggcaagagaaaaatgatggatacagattttcaagagaccattgctatctgcgtagcaatgaggggaaaaaacataattttaaaaacttgtagtctttaaactcattgaagacctgtgtcacagagaagtttaaatgaacaaagctcaagagaaacactacatcctcctagaaaagaagtgcctggtggccatttgcatccctgggagcattaactgagtcataggtagataaaggaacaagtcttctacaaataagggagcttttatggtacaaggagaaaccagctgaacttttatagccacttgtgggcagacatgacagattagaatatgggatcctcaaacagagctagtccaacccccacactgaatctcagcaggacttttgttgagtaaaaagtgattaagaaaattgggactgagctagagaaagaaggatcttaaaaccttgctagagaaagagacctgattccatcttcaagacatttgaaaccaaagacatttgaactggaactaaaaggttcaactcagataaactcctagttagattgaagagatatattcttcactctactcttggcaggaaacaaagcactttctctgggagaaaatattttcttctttagtatccttttatattcaatgtttagcaaaaataaaaattttgagagacttgaggagaggaaaatgggatccgtaatcaagagaaacaatagtgtaaataaactcatcaataacccagatgtttgaattaacagacaaaaaaaaaaaaacttatgttaaagaatttagaagaaaagatggtcaaaactggtaagaaggtagcaaatttcagcagagaaatggaaactaaaaaactaaatgaaaattctagaacaaaaagtactatgaagaattaattggttggacttattggagtcaggtcagtaaaaataatatgcaaacagaagcacggaagtagaatgagaaaagagcatcagagacctgtggggcaacattaaatggtctaacatgcctgtgactggaatctcaggagagagaatggggcagaacaaaatctgaaaaaaaaaaaaaaaaagtctgagggctgggcacggtggctcacacctgtaatcctagcactttgggaggccaaggtgggcagatcacttgaagtcaggagtttaagaccagcctggccaaaatggttaaaccccatctctaccaaaaatacaaaaattacccaatttttttgtgttttggcgcatgcctgtaatcctggctacttaggtggctgaggcaggagaatctcttgaacccaggaattagaggttgcagggagccaagattgtgccatacactctagcctgggcaacagagtgagactcttgtcttcaacaacaaaaaaaactaataacataattaagattgaaaaaagaaaatgtctgagaatgtttcaagatttttgaaaagatacaaagccacataccaaagagtgaacagaaccaagtggaaaaaaaataaacagaaccacagctaactacatcataattgaattaccgaaaaccagtaatgtgttggacaggagtgttgttaaggcagtgtattatactttaattggaagtgttttttcttttttagagattcataaaagtgtggcgctatttacagctttcatgaaatattaaaagcagccagaggagaaaatacattgaattcagaggaacaataaaaataatgacagctgacttcccattggaaacatagaagtccaaagaaaatggaatgacatcttttaagtttttaaatttaaaattacaggcgggtgcggtggctcacgcctgtaatcccagcactttgggagaccgaggcaggtggatcatctgaggtcaggagttcaagaccagcctggccaacatggcgaaaccctgtttctactaaaaatacgaaaattatctgggtgtggtggtgcatacctgtaatcccagctactcgggagggtgaggcaggagaattgcttgaacccaggaggcggaggttgcagttagccgagatcacgccactgtactccagcctgggtgacagaattagactctcaaatgaaacaaaacaaaaagacaaacaaaatttgatttagacttctataaccagtaaaaatgtttaaagaatgagtacaaagtgaaggcaatttcatacaaataaaacagagaatctcccaccatgcactacaagaaatactaacagggtttttaagctgaaggaaaatgattctacatggcaacctgaatctgcaagaaggaaagaaaagcactagaaaatgtgtggaaaaaatggaaagacgagtattttaaaaacttattttacaaaaacaaaatcagtatattgtggagtttatcacacagaaaagtaaaacgcatgacaaaaactttacaaaaggtaagagtaaatgaggtacactattacaaagttgttacattgtgaaatataatttatttcatggtaatcaaggtaaactgataatttaagaatatatgttatactcactgaaagtaatacaaagttatatagctaaaaagccaattaaagcatataaaatggagtactgagaatgacatgacagaattcagtgtaaggattttggagtagtagaagcaggaggtttagcttagaaagtggtagcgtaggtgttagattatgaagggccttttatatcataccaggtagtttgtaccttaccattatgagccactggaatttattttaggcagacgattgatatcatgttatttacaaaattaactagtaggattaatatgttatttacaagattaactggtaatttctactataaattttgtcttactgtaagatactgtcttcaactactagggtttgaggggagggaaaggacttgacataaattggagagactcctaggatagaatagatagacctataagacttatgcaatattgcagtaagaagtagagggaagaatcaattctttctgtagtatctgcctttggaaaccattggatgttggtgttatatgagaaaggaaggttaggtgtagtatcaaacccaaggaagaagataatgagttccagcctgagtgtggtcgatttcatataccttgaggatagccaggtggagttaatgagtgagcatctgtctataaaacttaaaagagtagtgtaggtctcagatatgtgtcttagttaaccaattctaagatgcacattttgtcacacttgacgtccctggaaacagattgtggcttataattaatggcctcccaaaatcctttttggaaaagcagcagttttggatgttcttattgttgtatcaattgaattttgtgcaatattaataattcatgtgttgattggaggaataaacaacttcatattttattgcaacaattgctttatgagagttaaaaagggaaatagtcacaactaaatgaagctgcattaagtgccaaaggattgctgtcatatgcaaagcattgaaattgatggcaccagaagaaattgccatattcatgggagtaaagaaatttcaaaggaatgagaggctgatgtgtccatttcatgtgttacacgggactgttgttaaggcagtgtatcatagtttaattggaagtgtttttttcttttttagagatttataaaagtatggtgctgcttacaacttccatgaaaagaatcattggcatataggtagtagttgaagacatgggaatggaggaaacatctaggggaacaaagaatgaagtgaggtctctgtgaataggatctggtatagattctggtgtgtgtgtattttccatttagcagtagaggcagaatgcatacctgctctgactgctaaatgcatgcatttcttgatctccatcagcttttgctccaaaatttggcagtgacctttttactttcctaagccaaagaatagtagcgccaaagaatagtagcaccaaagtgttactagtgagaactatgtgttctcaccatgttagaacatggtgttccaaggaatttaatcctgcctctggaagtgatgtatgcaggtaagccaaggaaatgctctatataaaaatagaggaagacccccccccaaaaaaaaatcattagtaatgttatatgctaatgaggcaccagatcaagaaaaaagcagaaaaacatcaagtgtgagcaaaataggaatattgcacttcctttagtctttttccacaaaaatcttttccccccaatcttcttttatttttctcttatagtaaatttcctttcaaaaattgcaagtactatgtgtcttccataaataaataattcagacaaatacaaactttattactttctcttattttctttaagtattcatttaagacttttttgttaaatgcctacagattattcattgttgtttaaggtgctagggatataatggcaaacatggtagttctttgctctcatacttgtattctaagaggcgaggcagacaaaagttttttcaagtagtgacattttctaaaaagaaagaaaacatagttccactgtagaagcagcagccttggatagggcatttaaggatggattttcaaaacatacgatactctgggccaggcgctgtggctgacgcctgtaatcccagcactttgggaggccaaggtgggcagatcacgaggtcaggagatcgagaccatcctggctaacatggtgaaaccccgtctctaccaaaaaaatacaaaaaattagccaggcgggctggcaggttcctgtagtcccagctactcaggaatctgaagcaggagaatggcatgaacctaggaggcggagcttgcagtgagccgagatcatgccactgcactccagcctgggcaacagagagactccatctcaaaaaaaaaaaaaaaaaagatatgatactcaagctgagatctgaaagagttagctgtggaaaggttgacagaagaacatgtacaaagggtctgaggtggaaacaattctgatgtcctctaggaacagaaggaaggacatcggtaggagagaagatagccatggaacaggttgtgtaggacagtgtaagctttaattcccaccccttttctccagttaaccagtgttactgatatggtttggctctgtgtccccacccaaatctcatctcgaattgtaatctccatgtgttgagggagggacccgtaatccctatgtgtttagagaaggtggtgattggctcatgagggcagtttctcccatgctgttctcatgatagtgagttctcacgagatccaatggtttttataagtatttgacagttcctccttcatacactcacactctctcatgccgccttgtgaagaaggtgcctgcttccccttccgccatgaatgtgaatttcctgaggcctcccagccatgtggaactgtgagtcaattaaacctcctttgtttacagattacctattccagggtaatatctttatagcagtgtgagaaggaacggactaatacagttactgataacagtttgtaacattgagttacaagctactgttaggccttctcagacttacattatatctcatgaatctttatttaagttatgttgcaaagcccacccacattagcatcttctgtttacagtcaaacttttaagatgctttgcacaccacatttattttctcatcttgttgtcacaaaatgtctttttttccccccttagaaacagggttttgttctgtcacccgggcttgagtgcagtggcacagtcatagctcactgcagccttgaactcctgggctcaagggatcctctcacagcctcccaagtagctaggactataggcatatactaccatgccagactaattttttatttttaaagacagggtctcactgtgttgcccagtctggtctctacttcctgggctcaagccatcctactgcctaaggctcccaagtagttgggattataggtgcaaccaccacacctggtgaaatctctattttgatattatagtcatttggttagagtttatcttccattattttcatcaaatacatttgggtgctatacttctggatctttgcaagtccaaaaatgtcttcattttgccctatacctatcttaactgggtgtcaatttcttaatttcttcttaatagttagtaaattgtttgtcttctagtgttataggtgagaaatttgatgttagtcttttcttgtaagaaacttgttctttctgtatgacaatgtgtaaaattcttttcttgtcctcaaaatttaggatttccagtagaatgtactttcttttttcttcctaaaatatttctccttataatgaagtaagctcttgaaatctgcacttaagcctttaactcaaaaattttcttctagtatttatttaattacatctccatttgtttctttttctccttttggaactttaaaactaccagtaatttctttttctcctcttggaactttaaaactacgtaaaattttacactacagtttcaaagtcttatacgttccttatgattgccattttctttgtgtttttgctctgtgttataagcagtaggacaaaaattgacctattgcagcaacttcagcctttttgactgattcacggtaataaatatattttacatagcaacccagttcacacacagctaatcaaaacaaaatgtcatgacataatatttatcctaactataggtgatgcactctatttttctagtttattctatctttttattctattttatttttaaaaaaaaagatggtagtttttaaatactaaatcagtggttctcaaccaaggcaactttgtttcccagggaacatttggcagtatctggagatatttgattgtcacaactaaggaggatgctactggcatctagtgggtaagaggccagagatgctgctaaacattctacaatgcacagaacagtcccccacaacaaattacctggccaaatgtcaatgctgcgaaggttgagaagcactacactataaatttatttcattactcctcagtgtaatgattctctactctgactgtacattcataagaatcacatggggagattgatttcataactcagattaactggtgactagtagtttttaaatgtttcattcttcagtgttttaaaaatatgtacctatgtacctatcgtatatggctatgacaaacattcagtcctaattttatgtggtagtggtgtttttttgagtaaaagctagtggttaatctgatagttcagcagtataatttttgcacctttattcagctttccagttaaactataagttaaaaaaattcttttgttaggttatcctgtgtttttgaatgttgttgaaaatgaggtaaatttaactaggttaccagatattatttcaggtaagaatttccagtaacataaggttattatataaactgtaatattatatctcctataaattatattttaaagtccagaataagcaccattcccaggtagtttgagcacagcagatttcttatgatactgcgttcttgtaagcccatgtttctacgcagtgatagaagtaagattatacttctttagaccacatagacgaggtcatacttcgtaggtcagtcttgttacaaatagaagagtctagcatggaatcagagtagtttgcaaagttgagcctttgggtttctagaattggaggaggagaccttcagttatagaaggggttaattacaaattgtatacggatttgaagatctgtgacgttccttccaaatctaaatgtgcttttctcttgtctgccaacaggtacaactgtaactgctttaagattatttaagaatctacctgtaagaaagcagttttactcaactgcaaaaaaatgtaaagatgaaataaaaaagatccaagatctcctcatgagctttggtatccttaaacctgacttaaggattgtctttgtacataacaaggtaaacattattttatctttataagtttctgggtatatgatataataaacaatgtatactttataaatcagttagatatgggctatgactaaatgtttgtgtgccctcacaaaatttatttgttgaaaacctaaccaccatgtgatgttattagggcatggggcctttgaggagtgaaattcatgctcttaaaataaaggagacctcagagggctgccttccttcttctgccatgtgaggaggccactacatagtcagaggcaccacctatgaaccagaaagtgggacctcactagataccaagtcatctggtaccttgatcttggacttactcagcctccaaaattgtgaaaaataaatttctattgtttataagccacctagtttatggtattttgctatagcagcccaaagacaacatgtaaagagtctttttttcaaaatgttagtccacatttatctagttttatctttattacataaagagtgtctttaatttgttgcctaatatctatatgatctgattgaacttttcatttcttaatctctgaaatcagggattcccccagcagacgtttttcatctaagaaatggcttgagtgcttccttttatcgggtgctgtgatagattctcaaaatatgaaaatgagtaagactggttcttttcctttaaagacttcacaatttagtgacatttttcaccctctacactgttgattctttggaagagtgtgtgtgtcaggaggatacaagtgtaattttgttacatggatatgttgtgtagtggcgaagtcagagcttttagtatatccatcaccagaataacataccttttaccttttaaataatttgtcatcatccaccctcctccctctctacctttgtgagtctccattgtctatcattccacactctatgtccatacatgtggtttagcttccacttataagtgaaaacatgcagtatttgtctttttctgagtttcacttaagataatgacttccatttccatccttgttgctgcaaaagatgtgatttcattcttttttatggttgaatagtattccactgtgtatacatacacattttctttatccatttatatgttgatggcacttaagttgattctgtatctttactattgtgaataatgctgtgataaacatatgagcacaggcgtccttctggtataatgatttcctttgggtagatacccagtagggagattacttggtcaaatagtagctctatttttagtttttttagaactaaaaatactgttttccatagaggttatactaatttacattcccatcagcagtgagtaaatgttcccttttctctgcatcctcaccaacatctgttatttttcatccttttaatcatagccattctgactaaggcaagatgatatctcattgtggtttaatttgcatttttctagtgattagtaatgttgagcattttttcatatgcttgctggccttttgtcttcttttgaggaatgtcaattcatgtcctttgcccactttttaatgggattatttgtttttgttttttgagcttcttataccttctggatgttatctctgttggatgcagagtttgcaaatattttctcctattctgcaggctgtctgttcactctgttgattgtttcttttgctgtgcagaagcttttgagtttaaggaaaactccagctttctttccatttttcaaagcgccgataagagaaggtagtcatcttgttgcttggtgaatcttaaaggaaagaaaggtttatatattttctaattattctgtttatctaatgaaatttcacatgggtatcctgcaggaaagcaaactacacagcaatgtggaaacctgatgggaaatagggaattaacatctattgagggcctacacaatgccaggacctgtgctaggtgtattagttttctgtaatcctcacagcaacaaccaagtgatgtagggattatatcagttttgcagttgttctctgaatggaattcagataggtttaatactttgctcattgttgtgcgactagtaaattgagatgggatttgaaacttaacatgccttcagagtgctttgctctctaccatgctctcttccttttttttttctttccttttttgagagggtctcgttctgtcacccaggctggagtgcagtggcacgatcacagctcactgcagccttaggctcaagcaatcccttccacctcagcctcctgagtagctggggctacacatgtgtaccaccatgcctggctcatttttaattttttttgtagggatatggggggtctccctatgttgcctgggctggtctcaaacttctgagctttcaagcaatgcaccctcttcaagcaatacacgctcccaaagtgctgggattacaggtgtgtgagctactatgcctggccctttttcctattttaatactactttatatttatatagttttttcccatgtttcagaacagttacaataactttgtgagatagaaagcattatctctgtttatatgggggaacttaaagctcagagcaactaatggaattgttttatattttacagtaatagtgctgaggtcagaaccctttttgatccagttttcttattgtcaggaagattctttattaaagctatggtagaatgtttttgatcaaaatctttgatcatttaaaataagaatagcaacctgttcttgttggcatagagctcaaccaaatgataccttgagatcctttccagtgccaccgtgctatgattccttaggatgttgatggatggaggctcatcctattaataaaaataaccctatgacctctggatccagaggatatttagtaataaaaagtttgtccctaaattaaaaaaagaccaacatcagaaggaacataataattaggaaggaaaaatagatgaaaaaggtaaaatataaagagaaataggaattatatatttgtaaaagaaaagtgggctgggcgcagtggctcacacctgtaatcccagcactttgggaggctgaggtgagtggatcacgaggtcaggagatcgagactatcctggctaacacggtgaaaccctgtctctactaaaaatacaaaaatgaaccaggcatggtggcatgcgcctgtagtcccagctactcaggaggctgaggcaggagaatcacttaaacccgggaagcagggaggttgccgtgagccgagattgcgccactgcactccagcctgggctacagagggagactccgtctcaaaaaaaaaaaaaaagaaagaaaagtgagtggaagagaaatctttcgagttagaaaatataataagtgaaggctgggtccggtggctcacacctgtaatcccagcaccttgggaggccgaggtgggtggatcacctgaggtcaggagttggagaccagcctggccgacatggtgaaaccccatctctactaaaagtacaaaaattagacgggtgtggtggcagatgcctgtaatcccagctacttgtgaggctaagacaggagaatctcttgaacctaggaggcagaggttgcagtgagccgagatcgcaccactgcactccagcctgggcgacagagtgagaatctatctccaaaacataaataaataaataataggtaaaaacaagattattacttcacgtgataaaaatgaatatattagaaatatttgaaatgacagagttcttatttcaagtcaaatatgtatcttctaagtttttttgagaggtttatatcattttcccaaccaatgtaagattatcaatgtgggtattttctttagaaattggaaagcaggcgccccgccactcgctctccgggcggggcgggtggcgcctcgggcctccacctccccctgcctgcgcgtgtcctgcgtgagagggcagaggcagggtggaggcgttggcacgggacatgtgggccgcggttgccgactgtggcgcgggcagtggaggaggaggcggggctggcgctgaagtcggatccggatccgttgctgtgcaccctggtcggggagagtccgatgcgcctgggtaggagcaccgactgcggggcctctaccgaccttactagaaagatgaaacctgatgaaactcttatgtttgacccaagtctactcgaagaagtggactggaggcagaatacagctacattttctccagccatttccccaacacatcctggagaaggcttgattttgtggcctctttgtactgctgacttaaatagagggtttttttttaaggtattgggtcagctgatcgagactggagttgtcagccctgaacagtttatgaaatcttttgagtatatgaagaaatctggggattatgttacagttgtagaagatgtgactctaggacagattgttgctacagcaactctgataatagaacataaattcatccattcctgtgctaagagagtaagagtagaagatgttgtcgttagtgatgaatgcagaggaaagcagctcggctaattgttagtatcaacccttactttgctaagcaagaaactgaactgttacaagattacccttgaatgtctaccacaaaatgttggtttctataaaaagtttggatatactgtatctgaagaaaactacatgtgtctgtttctagagtaaaaatcttataagaaaattgtcaaaggagctaatgctacaaggctccactcttcctagagttaaaatattttgttgctgcagcagagtgacctccataaatagtagactgagaaaacattgtaatactacaagtataatgacatctacgagattactttgggctggtgggaaatgctgtgaatttagattacaaatgaatattataaaggggatttttttcatctcttttttctttttttattttattttacataattcatgtcttgatctctaaaactaggcagtcacctttaaaactttggatctttaaaaacaaataccccgttactcctaaaatttaactgaaaaaactcacagatttgggtttttttgttttgtttttttgttttgttttgctttctgcttagattttatttttatttttttaatttatttttattattgtactttaacttccagggtacatgtgcacaatgtgcaagtttgttacatatgtatacatgtgccatgttggtgtgctgcacccattaacttgtcatttacattaggaatatctcctaatgctatccctcccccttcctcccaccccctcaacaggccccggtgtgtgatgttccccaccctgtgtccaagtgttttcattgttcgattaaggggatgatttttaaccaagggaatatattttaaacttgaatcttttcttgcattgtatttttccaaaagtttggcttcatttcttggtagttaagagtatgggtaataaggagttatatgtctgccgtgttgctcatttaaaaaaagtatttattgaataaggctgttttttatcacaggcataaaatttaatctttttgtttcaaagaaacatctcagtacacttaggggtgtatcgtttcccacatataaagtatttattgaataaggctgttttttatcacaggcataaaatttaatctttttgtttcaaagaaacatctcagtacacttaggggtgtatcgtttcccacatataaagtcaggctggataaattagttattataactaaacacagtgtagtccaacatttgttgatcccaatacaggcaaataacctggtcagccttttaaagaagtagaagaaatgaaaattatttgacaagattaaaagtaaaacaatttaaatgttttactaaaagtttatataggtctatgtagataaaaagtaccacttgtcttatctgtgaattataactgttcctttgttaaaaacacctaagagcaattatggtgggacatctaaggtactttttaaacagtgaattagcaaacctcagcatatgtgtttctaccttgatttttttcttttcatgggtatctgaagcctcccttctgagtaacaggtttttcaaaaatggagtatcacaaaattgagtgaaatacaatactgaaacaatacttaaaaatatattgtaccagatttgtcaaattcataaaatgttgatggaagctttactttttagtgtgattataatggcactattctggtcattatcctgtttttattttatttattttaattattttttaaagttgaagaattaaatagtttaatggttctaattttttgcattccatgttacattaaacctgttcatatgatgagtaattttctgttaggaaataaaagaaattggaaagcagtatttatagtgtactacattttattattttcggaggacactgtatcagaacttatatttagcaaacacaagttcctctatagccttcagtaatttcagatgcagttcaaatcctggagagtatgttgaaatgattatactgtgaaagtaatataaagtttttaaaagtctttttgtaaaattaagtattagctattatagagagaaatcatggactgaattagaacaagctatttatgttcaagcttttttctcatagtagatttttttatttttatatttcttaatagtgctgttgcacctttaaaatgttaaaatatattgttaaacctcccaaaatagcaatgacatgttactataaatctctttgaacattgagtcctactttgctcttagcctttttcttttaagcatgcctactttcatcattctatatgtacttttttgtaaagaatttttttgtctgcttagaatttaaacctgacgatattgttgtctttattttttttctgcattagagacaaacaatcatattgcgcataatacgagaagtactattgctattttgataacttggattagatagtgttctttctttttatgaaggtttaacctgccaagacattctttgaatactgataatgttgatgttcttgccagtatggttatgttagaaagaggtatttttcttctttcatcaccatgttccttgaaagcatagtgaataatgacacagccaaagggaaataatttacaagtggattcagtgagtttatttaaagtagatattatttggagaactgctagagccattccttagatgagcactacagaagctttagttgtaataactgaatccctgtgaggtcctactgtaaatatttttatttataaagtagttattttgcagaattaacagttttttctcaatattatagtatctgaaaccactttagtattcttagctatttcatatgacaatgcataatttcctagaccactagttcagaacataatgtgaaatgtatgatttcaaataagggctactcctatatacattataattgctgatttgtgtgtgtacttgcttttccaaaaatattatttgtggttttaagaattgttttgattgaattttgttttgataattagaggcccactggtattgcaaaagctgaattggatgtcattgataaaagaaggttttaactgttacgaaagagagacatgaattaaagaatgttttccttcctattcccacttctatatcacatgagcattaaggcttattgagatgttggttttcagtgttgtctttgtttttgttgttgttgttgtttctttgtatgttttgtgctctgtaagaatgatgtcagctccgaagtgttgaatatctctgaattcagttaatctgggaagatgcaggcccttaaccaggaacagagacccaaaaaactggccgtggagatttggcagtgagtggtggctgaagatttggtttataagatgaagataaataagtgatgccctataatatatatcccctgcactcatgatattctccatggtcattttatccttctctaaccttttacgtgatcatcttgaatgtcccaggtttgtttcgcctgtgctatggggaatcaaagaaaagtcttttgccgcatttggaccaatgttaagggtcagttcccctcccgcaatcccagccaggaatgtggagtcagtataatcagagagaggttctaattcaggagtgtggctcaaatgccccttccttaggaatgaattattccagtgccaatctggaaagtttgggtgtgttttgtttttgtttcttttttaattaaagaaggcggacatcttttcagatatattttaagattagcttggggctgattatcaatatggtttggtttggggtcttttttttttttttgctacttacaaattaatgattactaaatttattaaatggttttcatgtgttcctcttttgttaaggattacttttcacctaaattttgtgaaatatagaaaagatgaaagacatataagtcaagttttagtgtagttttatgtttgtaagcactattaggagtctctgaagtcttccattatccctcagtaggacattattcctcaactgctctcattttgttttccacgtatttctgttatgtcattttgcttcagtggcagtgatttgcattctttctttcctatttgacagccttttataggagggagggctgcatctagttcatctatattccccttaatagtgagtgcatagtacaggatggaatattaaattaattaggtagtgttaaagccaaaatagtaagtgtatgaaacactagttttaaacactctggcctctctcagaccttattcataatatttattaataaaattcattcttttgaattccttggtgacctcttatgtatttagggagtatattttcacttgtattcacatatacaattctagtccattgcccttcctggaagctaagtcactgatacatcttctttagaactaataaagaatcatataaagactgcatggatggggcagttgaggggaaacacttgatggacagtctctaagagctgtcaatttaatgtattttgttgctattaacagtcaaatagaacaacataattgttcctttactgatcctctaaccacatacattttatatacttattattaacccaaacacacatttctctattccaacactgtagatttctcttccaaacaataatacccagagaatcctgtacaaatgtagctttttgagattaggccaatgaaagtcaatgacatgatctctaaggccctttttaactctaaaactctttgatttttaaggatgtttacatatgtatatcttgagcacttcatttctttcttagaaaattggaatttcacatttttacttagaagttctactgagttcatatatgaaatcataaaataataaaaggtagaaagttctgcaataaacatggttatgcagatctctttgacatactgattttcaacctaaatgcccatcaaatgatgaatggataaagaaaatatcatgtgtatccactgtatatacaacagaatgccatttagccataaaacagactgaaatcctgtcgtttgcagcaatatggatgatctcggaggacattatgttaagtgaagtgagccaggcacagagagacaaataccacatgatctcacttatatgtggaatctaagaaagttgatttcatagaaatagagagcagaatagttgttaccagaagctggggaggggagggagaaggaggaaaactggaggggttggtccatggggataaagttatggttaggaaaaataaggttttgtttgtttgtttgtttgtttgtttgagacagagtcttgctctgtcacccaggctggagtgcagtggtgtgatctcggctcactgcaagctccgcctcccgggttcacgccattctcctgcctcagcctcccgaatagctgggactgcaggcacctaccaccacgcccggctaattttttgttttttttagtagagacggggtttcaccatattagccaggatggtctcgatctcctgacctcgtgatctgcccaccttggcctcccaaagtgctgggattacaggcgtgagccactgcgcccggcccaggaagaataagttcttatattctgtcacaccgtagggacactatagcaaataacagtgtattgtgtatttcaagatatctagaagagcttttgaatgttgtcatcacaaagaaatgagaaatgtttgaaatgatagggtaattgccccgatttgatcattgtattatgtatacatgcattaaaacatcacattgtacctcataaatgtgtaattattgtgtgtcaattataaatttaaaatcaaatgctttaaacactcaattgcagagttcactggtaaatacttcactgtaataaagcatctctcacaatgtatctctgaagaaacattctcagatttagcttttcaacctgtatatgtaaactcttcacagtgtcacagtggtaaaattaaaatagttaaaaatcatgctctagatgaaaaaactagattatagggtttactggtaaacattaagttcactgtaataaataagctcacaatgcatctctgaagaaacatgcccaaacttagcttttcaacctttgtatataaactctgccataagtcgcaatggtcaaaaccatagttagaaagcatgttctaaacatttgatgacagagttcactgattggtaaacagtttaattcactgtgagaaagcagctcaaagtgtgtctctgaaaaaaaaaaaaaaaaagaggacgtagaaggatccttagatctttacatctgaaaagaccactgaaaatgttttttgtcctgcctcaaatcttttagcaaatagtgtttttaatcctgtccacctccccttttacctttatgtgaccccaagagttttagtggattgcccaatgacttaaacattgaatatagtagaggatgaactacagttcacatatcttaatttttaatgcatcattcatcctcccttactgtagcttcctcccaccaactatactcagagtactgagtaggtgctttggaagggttaagtgatggcttgcactctgaagaaagttacgatgtaaatgaggagataagatgtgaaagtgtgtaaacataacataaatataccgtagaccttgtcattgcccaaaaccacactcactccataatttcactgttaatgtgttccttctctaatcactacctgatgcctctctatcttactctcttcaacaatccttagactctgttggacctgtgatcccttgttcctactgctttttaactgtttcttgccccctggtgtccttggttctctccttaccctgcttaaattttgtggtccatcattatcatccttctcttgggcactctgtcagttctcttggtcctttctcacttaattgtacttgtttgactaaatcctgattaaatccatctggtcatcattttggtatctgagccagtatgtaggggaagaaaacccacacccatgctgaatagtgcctctgtaaattcatgagcattaatcttcatgctgccagacagtcatactcctgtttttccagtcagcaaaccagaagccttagggttattcttcgctactgattctctcacactctaatctgattccagagtaaattccgtaggtctatctttaaaatatatccagaatctaacgacttttcaccatgtctgtgactaccactgtggtccaagccaccattatctgtcacctggatttttgtaatagtatcctaatggactctccctgcttacttcttatcctcttcagtgtattttcagctcagtgattctgtaaaaatgtgtcagatcatataactcatgtttaattagttcccatctcattcagagtaaaatcaaagcctttataagcggactgtgaattctctattggggtcagtatatttttttctgtatagagtcagatggtaaatatgttaggtttttagggccgtatagtttctcttacagctgttcagccctgttgttgtagtgtgaatgtagccataaacaataatactttatttacaaaaacaggaaggccatgggctgtagtttgctgacctccgtagatctgatgcctcctttacctctgatttcattaatctttttccttttgctcattttgcttcagttgtttctggaacctgcgagtcatgcttccagctcaggactgtcgcatttgtagtttctttgcctagaacattttccctcaagtaactggttcaatcctcaacttttaggtcttcacttaaactttctccgtgaggctttctttagccttcctaaaattgcaaccatttcccctgtccccccgcttccccactttcctgctttatttttcttgaacttatcagtatccaatatgctatatattttatttgtcttgatttattctctctcctcctctagaatataatttccttgaagggaaggactttggctcttttttcactgtcatatccctagtgcttacagtagtgcctcaagtgggtgctcaaaaaacatgtcaaatgaatgagggctgacaacaggatcaagggctgagaacaggagcactccattatgctggtggcaccagcccagctggactgtaagcgtaggccttaaagcacctgagatccagaagcagatggtatcagtgtagattaaaggtaacaactggacagagagatagcaaaacagcaagtattagctctcatactctagacacttcccacttctattggttgggagacttctagaaagtcaccaaaaagggaggggtgagcctggccacttggtaggtgggtggtattcattcagtggagtaggaacaactctgaacgtgattttcatctaggacccccaggtggttgggttataggaaaattttgttacagcagaatttggttatgtggataaaatggtcaagattattctaagtagagatagagaaatagtttaaacataaaatacataggcaggagagcacatttagaggcagtgaagaagtttctttaaatgagttggtatttaatatgagagaatagaggaagataaatccagcaatttaaactttttaaatgagaaaattggaaggcattaaaagtttttaagtagggaattgacatgatcaagatgctgctacctttgaaagtcagtttggcagtactctacagggaggagctagggagaccataaacatttaggaagctgctataaattgtaggctttaagggcctgaattcagacaaacacattaggtgtgaaaagcacaaagtgtctattttcttttatagctattatgaggaagaatcaatgggactagctgtgagtggcaaaggaccagaaaaggtttgaagataactgatttatttaacttatatgcctaaggaaataatactgcatccttttttaaaccctgaatgcacacatttgagtttctcctataatgtattaccttcatgaattacactgacataattttgattttactcctaaaagaagcttatagaaacaaaacttttaaagtgaaatcattactgcaccagtagagagttgttagtcaattcagagagaaaagctaatcagctctaggctggatagtatttattttttaaaatttaaaaattttttttttaagacagaatcttgctctgttgcccagggtggagtgcagtggcatgatctcaactcactgcaccctccgcctcccaggttcaagcaatttctggttatttttagtatttttagtagagatggggtttcaccatgttggccaggctggtctcaaactcctgaccgcaaatgatcctcccgcctcggcctcccagtggatgttatttgttacccttaaaacttgttgcttgttttgaaaaaaggcccagaagtagaataaagaaccatattgttgagatgtttgcctgaacaaaataggttgtatgggaagggaaataacattggttaggtaccagggagctagctgatgggagtgttataagctcagtgtctgtgtgtttggtcttaatttgaaggagaataacttaagaatcatgtagaggatggagttgtaatgcagaagagatgattgggatggcttcattttgaatgaaaaacaatgtaatctatagggtgttctattaaatgaaaatagtaaaggctgaaatcaaatactgctatgttgttacaaagcaatagcagcttgatttgtgagtaaccttttctgtaaagtcaaatatgttagaaatgagcaattgcctcagggttcaaagactgaagaacttatcagcaaggctgaccagaagggttttcttttttttttattgagatggagtctcactctgtcgcccaggctggaatgcagtggcacaatctcggcttattgcaacctccgcctcctgggttcaagcgattctcctgcctcagcctcccgggtagctgggactacaggcgcgtgccaccatgcccagctaattttttgtatttttagtagagaccgggtttcactgtattaaccaggatggtcttgatctcctgaccgtgtgagccaccacacctggtcacgttttctttaaacagtattaagaagtacagataatatagaggcagagaagagagcttcaaatattgtcgtatttacctaactttagtgctgtttgaaaggtaggtagtgaactttagaaggccagttattgaaatatttgttacttaaatagtagtctcctattcctaaatcattttattatgtattttaaataataaaatacaaaatggatactactgtattgaacagctcctgaatattattactagtgtcaagaccaaccatctccctctgccagctttgttcttgaaaacagaatgttacacattttaatgtggtaagtgggccaagagagttctaaaaggtacgtttttaaaattcatccccaatgtctaaaaacacacattaacttctttttcttcttccttttctgtgtgaaatttgagtaaacttactgttgatttgcttctcatagaatagtgttgaccttttctcgtagttgcagtgacctatatttaagttaaagcttgagctggctagtataagaaacaaaatttgctttccattagttatttaaatatagttaatataagaagtaaatttatggccgggtgcagtggctcacacctgtaatcccagcactttgtgaggccgaggcaggtggatcatgaggtcaagagaccatcctggccaacatggtgaaaccccgtctctactaaaaatacaaaaattaactgggcatggtggcacgcgcctgtagtcccagctactcaggaggctgaggcaggagaattacttaaacctgggaggcagagattgcagtgagctgagatcacgccattgcactccagcctggtgacagagtgagactgtctcaaaaacaaaaaagaagtaaattcattttcatttgggtaattaaatatttcatatataccaactgatactttttcattaggctttgcttataaactttaaatgttataatgatatgattatttttaaaaacctgaaccccccctacttccctgctggaagaaaccatacctgtagcagcactatgtgggagacttgtcttgatggatgagaataattcttaattaatcttttttcctttatttgttataggaagtgctttagatcttcaagatttttacttttgaggaaaaaattatagaactttcagagaccaccacaatcttcctttcatccttaggaagaacttacttaactacatatcaataaaatagactctggagcatagtttccagttctgaccttacatattgtcactaactggcttacattacgtgtctaggcttcaatttctttgtctctttaaaatggaataatagtacctaccttacagagtaaggtttttaaatgagagcattcacagcacagcgcctgctccataagtactcagtagaggttaattgctattgttattgatgtgaatattgtttaaaatctgattagagtcaaaaaggattattagaggaagtggccttaagactggttcttcggaaagactatgtgggcagaggtattcaaagcagggagaacagcatgtgcaatgtcagggagtcatcagaggtcagagaaagcttgtctaagaaatgagatgaggctacgaagcttgcttggagccagattctgaaggaccttgtgtatcttacatgggaatgtgtacttcttgttgaagtgaccaagagggaactaaatgagacatttcagtaggagactaacaaaataagataattctcattgcagttggaggatggactaaattatgtttaattgttgttaagaatgtggaaaatgatctcgttgtctggcaagttacacaaggaatggagaagagggtctaggcaagaaaaatatttccgatgtaaataagatttgattacgaattggaaataatctttcttgtttttaaagactgcaaagaaatgagtctcaacaatatccctttgaaagttatgcagagattaactttatacctttacatttttattaatgttttattctatttcattttatttttagagacagggtctcactctgttgcccaggcttgagtgcagaggcatgatcatagctcacttcagcctcaaactcgtgggctcaagtgatcctcctacctcagccttctgagtagcaaggaacacaggtgcatgccaccataactggctaattttttaattttttgtagagacagggtctcactgtgttgcccaggctggtcttgaactcctgcctcagcctcccaaagtgctgggattacaggcctgaaccaacatgcccagcttattatttaattttttaaaagatcatacctttacatggttgaaaacccaaaaatgtatgaaaaggtagaatgaaaaaattattcttttctttatctttcatctgcctagctcctataaactgccccttctttaggtaaaatgtctattaatttctttgcaaccttcaggaaaaataattatgcatgttctctttcaagaaaagaatataaaattaaataagtgtaagagattttagaactcatttatactgcataaattttaccaagacaatcatttttgaaagtttgaggctgcttagcaataatcaattcatattaatgtttattatgtcagtagaatgtggtttgttcttttaacagtagtattgatactgtgatggaataatctataattttatactgaattcaaaacatttagcagtgtcttagtggtaagctgctgtggctcatattgttcctgtgttgccaatgtgggaaataaaacaaccttttaaatattgtgtttgtgcctctgtactttttggagtcagagtcagtgcaagtacatacgcaggagtaaataataatagatatagatctatttatagtaacttgtaagatcttagaagtaaacttatggtacttaagaaatttgcctgggtatggtggctcacacctgtaatcccagcactttgggagcccaaggtgggaggatcgcttgagtccaggagttcaagaccagcctaagcaacatggtgaaaccctttctcttcaaaacgtacaaaaaaattagctgggcgtggtagtgtgcacctgtagtcccagctaatcgggaggctgaggcaggagaatccttgagtccaggaggctgaggctgctgtcaactatgatcacaccactgtactctagcctgtctcaaaaaaaaaaaaaaaaaaaaaattcattggtgctgcttcttgtttggtggaaaaaaaaaaatccaaatatgagcttagtacatctgtgcctacaatttgcaagaattttggctgcagtctaggccaataatatatcctctttatttagaaggagttgactttgctcaagcagttttagcattgtactattcacttaactatgcatcatctgtgtgcagcctacatttctctttatcacaaattgcctttacaaacaattgaggtttactaattaaatatcgagtattctcatctaacttcattttcttcaagtagcgtatgtcagtgaggtaggaattaggggcaagatatatttggctaacttcaaacctaagatggtgtgcatgtaataatatatttttgaggtgtttttgcactgtcatcatactgactagagtcagattcttagttggcacatccaggtgctccaactttgtgtgacctagatagaaaacatatggaggtttgtgtgtatttttagcacatgttaagctttcggcctaagggcaagatttacaaaaaccttcaggaagtgaaaagaaaatctctgtttttgaaaataacatagaattgatgaaacggtagagaaagcaaactgaatactgtattctggattcccagtattcccagttcttattcatcacattttatagtttagttttttagtgatgggtcctgttttgaaaatgaatcttagttgcccaatgagaagattttacttgttggcagaccgctattatttattgctagcccaagtgtaactagtttagaaaatgctcttaaattagcccctcgatctgatgcaataaaaattgcctagtgtgaaataatgctcccagactcctagcatgtttactttaaagtgaaatcacattgcatagttctcatgtttcacagctttttctaggaccgatttcctgaagtgatctttttacggttgtgtatactaactattcagcaggtcaggcagtgaaatagcatccttgcattaatcagcagctaagatttatatctgtatctaaggcatctaatataaactaaaataaacaagatgatgtttacattagtaacactgcaggctttttagctatattcagtgcaggaattttaaaacattagttttttgaaatatttccttgaatgctttattttaaaaatgtcaatatcagagagttagcattcctttaaagaggtacactttttgtgaataagtttggtgtttttttttttttctttttagggagggggtcttgctctgtcacccaagctggagtgcagggtgagccactcccacctcagcctcctgagtagctgggactacaggcatgtgccaccatgcccagctaattttttattttttttttatagaaacagggtcacactatgttgcccagtctggtattgaactccggacctcaagtgatcctcccaccttagccttgtgaataagtttttatggttcagctattctttgtcataaggaacttctgatgtggaaagtatgaagcaggggacatttcatttcctgtaattgcagattattcagaaccttatttacttcctttaattttgaacattgttccttaaattattagctgttggctggcttaaaactagagccataatagcagaagccagtagtttgcctttccagagtgcatgtgcacgcaaagattacagtctggcagttcttcaaaaaacatggagctaccatgtggcccagcagttccactcatagatctatacccaagagaaatgaaaacatatgccaacataaaaacatgaacatgcatgtttatggcagcatcagttataatagccaaaaagtagaaacaactcaaatgctcattaactcataaaaggataattcaaatgtattatctacaatggaatattattcagccatttaaaaggaatgaagtactgatataaataaacttgaaaaggttatgctaagtgaaagaatccaatcaaagaccatatattgtatgattccatttatatgaaacatcctaagtgggcaaattttatatagagagaagatagattagtgattgaaaagggataggagtcactgatgatggatataggttttctttttggactgataaaattgttcaaagattaaatcatgctgttggttgcacagctctgtgaataataaaaaccattgaattataaatctaaagtgggtgaattgtagagtatatgaattataccttaaactgttatgttaagaggaaagaaaagcaaagattggtttggatttccttaggtcaagtagtagacaaaaagtgtaattttaacaggtatggtggtgtgacaactagcagccttatctctgaaaacaaagagctagttttcaactctactggggttacttttccctagggaaaaaaaaatgtgtttatttgctcattcctttaacgaaagtatttagtatttagtgggccttactaggtgtctggtactgttcttggtaccagagactcaacactcaacactgaacaagctgaactcatcatcttcctgccaccaatcctgctcttctgagtttcttatcttgttgagtgttactaccaccattccagtttcccaggtcagaaatctgggaggcattcttgattcttctctttttattccctctccacatggagtcagtcatcaagcccatttcgtaccctttagtctgtccgttttctcttttcctcctaccagagtgttggttctgttaacacagcccagtaattctcagccgcagtatattaatactagtaaagtaccaaagtttgcaaatggtttatcttaaaaagcaaacgaaaaaaacctaagggaataatcctgtcaacatcagtttcactgacttgcattccaccgaacttttgcaagaggaagagaaagctgtagcatgatagctagtatattaggaattaattacacatagtcctcaggtcacctatcggaatattttttgaatgtgaactttcagttttgcatgtctttcgtaaaagctgagagtctctgagttggaggaatacaatcacttttttttttctttttttgagacagagtctctctctctgttgcccacattggagtgcagtagcgcgatctcagctcactgcaacctccatctcctgggttcaagtgattctcatgccttagcctcccaagtagctaggattatgggtgcccgccaccatgcctggataatttttttgtttttagtagagatggggtttcaccatgctggccagctggtcttgaactcctgacctcaagtgatccacccgccttggcctcccaaagtgctgggattacaggcacgagccaccacacctggcctatgatcacattttataaaaatcatattgctatagtttcagttctcactaagtcattcttgccaaagatctttttctaatatctatctctgatcatggtattttcccaattagatttatccagtgactctacattgcacgtaagggaaactataaacccctttgcacgatgtgccaggtcattcgtgatttagcccctatctgtctagtttcatctctagcaaggcattctctctatatgttcatgatttggcatgtactatcctatttgtcaggaatgcacttcttgtgatttgtcttagagacaaactcctgtcaagtctgattgtacttgtggcttctctgtgcaactgacttaggtttcttctatgatgctcccactgtgctatgtaatagtagtttttataatgtattataattattttaagattttgctttctttttatatttttagctcctttagagctgggaccttgtccttttatctttatattcccagattttagtatggaatctggaacaaaattgatgctcaatatgtatttgttgaacaaactcaaaattagttactttaaaattttttatttaaccaaaatatgttatagtatgagacgaaattaagggattaaaatatgcttatggtgactctacatcccatttcctggagcaattccaaatttaaatagtctacttcattggccttgaaatgtaattaacaaaacacaccataattttgtttagaaatgcaatatacacattgaacctataccttatatttaaaattgtatacaatttatttttatactttgatttcatatacttgttaaaagaaaaactttagataaactaaatttaacagtgtttatttgagcaaataacagtttacaaatcaggcagcccccagagccagagtaatttcagagcaagtccagggctgctgcatggtcagatgttatttctggacaaaaaaaaatgaaagtgatggacagaaaaccaaagtgaggtgcagaaacagctggatcggttataacttagtgtttgccttatttgaacacagtttgaacaactggctgcctgtgattggccgaaactttgtgattggtacaagagtaggttacagcctgttgacacatccatttaggttacatttcactatgtatggagaaacttataggccaaatgtaaaatatacaaggaggcaactttaggctaaacttaatttaacatactttatgtcttttttcttatacaggtcactttgaaagcaataatagtgaaaagttgaaatttaggatggagaaatacctgaattattttttagctctgctattttgctgtgcattatgatactaattattgcatatctgtatgaaaatgaatgcaaatttttgagaatttataaatccttaggtataaggatctgcataatatgattaaggttgttaccaagaactatattctcaaaaatattcagactttaggatgctagaatagtagctttcaatctttttggactttactattctaatgtgctttttttgagttgagaaccccagtgtactccttgccctcctaaaagcagattatttatttgaataggataaaaataattttgttttgtcttcactggtaccctcaattggagattacacagcgtatcacaaggccatgggggataatcatacatgaaaaatgcatttgtcagtcagaccctttactttttgagaattcccaattagagtctggagttggttctaaattgttgttgtcattgactagacaggggataaatattggcaaagtaaaaggagtgaatgtttagagccaaaaagattgagtatagatcttggttccatgacctactatttttgtttctttgggtgtaacaatttcttttgagtttcagtttcctcatctgtaaaatgagataataatacctacctgaaatgattgtgaaaataaacagtagtttctagaacagtagtacctaacaaagaataaggttttcataaatttcagctcttatctgattggtatcaatacaactctaggaataggtaaaagatcttcctgttaaactaaatgttgagttatttgtcttactgagtagttgttacactatctctgctttcccaagcaggttgctgtttgagactctaaaaacaaagtggtttgcagatggcacagatcagcaagcagagtcattgattattgtcaccttttccaggagagtgcattccttcatttctattcctgatgtgctagttagagaacatgagtctgtttacttcacctttcatcttattatacgtaatatcattaccactacttcctgactacatagattcctggttatggttaaggagttcctttggccagaatcctttggtccagtctcctctctctttctctgttatagacttctgcctcttttagactgtaggaaaacaagactctcccaagagtgtgctggacatcattggttttcaaatggttaaacaatgcaacttcacacatgtagaatgggaagcagaattttatacctcctccataatcatcaaatatttaaatcactgttattttgctttcaacaaaagacctcctttctgcattttagaacaaaggggagctgtctcagcctccagccactgagtctccaaacctgcttgctagtgtacccattcttccccttcagtttcctggtcaaatgtgtcctattcctgcctcgttatttccctgtctgcttgcatttcccagccagactttctgaaacacttgtttcagaaaagtccttttttttatatcctccccatagtcactatccaaattggttccatttacttctctagaactgttctcacactcttgattgccgtttagccagccacgtctgttcctaccatactcactcaacattggaaacatatgatgactactttcttcaaaaacgtccttattctgtgtaccacactttgctgctgctctttctgcctctgtgaccactccttataggttccttttcttcttgtgcctgcccctttaatgctgatattgatgttttctcccaagccctttggacagtttcctccagacttaggaattgctaagtgaatttgttgaattctacctgtactgatgatttctcaagggatttgactgtaattggaccttgttgaactgaagaaattgcagtatgtcaaatctgattatgtacttcacagccaaaccttggtctagtctctctggaccatgattgtcttaaaatctaccccatgttgacctaaaaggaagaagctgaggcagaattaatattgagagtttatttgaaccagtgttgaggacagctgcctcagacacacttccaaattactttggggagtgctccattaggcttctgttacaagcaggtttttaaaagcaaaaagggagacaaagagtgagttgatagagttgtttgtcaggaattttgattagtaattagctatacatcattgagctatagggcatggattatggtgtctggtgtgtggcattgttaggtcagtggctacttgtggcaatagcaagcagttttcaataaatacttagctcaaggggggaaattactatcattttaatgcctctctgggcctgataatttaaaagggctcacattttgcagatacaaagtatttatatatatatatatacacacacacatatatgtgtgtgtgtatatatatatttttttcttattttctttttttaagacagagtcacgctctgtcacccaggctggagtgcagtggcgtgttctcgcctcactgcaacctccgcctccccagttcaaatgattctcctgcctcagcctcccaagtagctgggattataggggcatgccaccacacacagctgatttttgtatttttagtagagacagggtttcaccatattggctaggctggtctcgaactcctgacctcaagtgatccgcctgcctcagcctcccacagtgctgggattacaggtgtgagtcactgcaaacaacctattgtttctctctcatctccaacatactcgcagtgaaaaaatccagcctcattattcagcttttatgtttacagattcagttaacattttgtgaattctctatttcaaaggtacaaaggtaattttaaattatgatttaattaagaatgctctttccgaaatttttatacctgtttgactgtttatgtaaatcctgtaacatagctgatcatcctcagtaaaacagtaataccttacttgaagcagcaatttgtttttaaatatacacggaagtctatgttttgaatgtgaggattggaggtggagagagaatcgatatttagtgaaactgttttatgccaggcacaggcatatgtgcttgtctccatatggatttttatcttccaacaactctgagaaatcttgtaaagaggagaaaaccaaggtaaagggaagttaaatagatggtacactgcaacatatacagcttttaaaattcagaaccagagtttcttctgtcagacctcatagctcatgaatctcttctaagtgatactgaaattttaagctgaggatgaatgcaaaatataggaataaaatactgacttcttgagtttagtaaatctaaattgtattaaaagttatctatatcatttttgtccctaggcagttatttggcagaaaagcagagtatcagatcacaagatggctctcatgtcagttctggggactgctgttatgaacaatatggaatcctttcagtaccactctgaagaatctcaggtatactgcaaaaacattctcagataattctgatttactcatgaagctgttcacatatttccctttgggggagttacagtggcaagaggttagtcttttaatattttaatcaaatatgtgtgtaaggtaaaacagtcaatacagagcttatgttaaacctctttccccagccctgcttccctttttatcttttctgtttgttgcttacattgattttcaaaaaaattatgttcaatttagaatcttttctgtttactttctactataaaagaaaaatagttggctgggcatggtgactcatgcctgtaattccagcactttggaagtccggggcaggcagatgacgtgaggtcaggacttcaagaccagcctggccaacatggtgaaaccctgtctctactaaaaatacaaaaattagccaggtgtggtggcacatgcctgtaatcccagctactcgggaggctaaggcaggataatcacttgaatccaggaggcagaggttgcagtgagccgagattgcaccactgcactccagcctgggtgacagagtgagattccatctcaaaaaaaaaaaaaaaaaaaactgttttcccccacctttcccattccaaatatgtacttaaaactttttcttgatctatcagtttagatagtacttttttactccctaatactggatgacgttcttaactcaaacttttcttcttactccttcctctttcagtcatatcagcaatagttttatattttcaagcttaattatatatataatttttttcttctttctttttttttgagacagagtctcactctgtcacccaggctggagtgcagtggtgggatctcagcccactacagcctccatctcctgggttcaagtgattctcatgcctcagcctccctagtagctagaattacaggggtatgccaccacacccagctaatttttgtatttttagtggagacatcatttcactatgttgcccaggctggtctcgatcctctgacctcaggtgatctgcctgcctcagcctcccaaagtgctgggattataggcgtgagccaccacgcccagcctcataatttcttatgtagccattttttaagtcttctatcttttgtctgaagattgattctaaaagttgaaaacttgtatggactataaaacaatcttcgttaaaagcccagtattgtagtgggattacattttacctctaaagatccattgttgtatctcttatgccatgcaaatgagaatattcctagagccctgattaaatggaatctctgttcttgtactcccatcagttgctcaaaatttatcatgtttttctttgcttaataaatggactatcttatgtagtttttcgctttttctgggattttcaaaagtttttttttaatgaaaaagttttcttcatcatgttagcaataaaatccaactcttagtcatcctaactgtagttggtaatccagttcattacgtctttttgaagtcattgttcttagaccccacttatttcttatttggatcatatcttaggccttctgcacaactctcatcttcagatatctttttataggaatgatggttggttgcattattactggtatgtcatgccttcctctttcttggcacttatactcatttttcttttttttctttttgagatggagtctcgctttatcacccaggctgaagtgcagtagcgcagtttttgcacactgcaacttctgcttccgaggttcaaatgattctcctgcctcagcctcctgagtagctgggactacagccacaacacccggctaatttttgtatttttaatagagatggggtcttaccatgttggccgggctggtctcaaactcctgacctcaagtgatctgcccaccccggcctcccaaagtgctaggattacaggcgtgagccactgcatctggccccatgctcatttttctgaggcatatctttaagtaacttccacagaaagaggggacatgagaggtaatttttcatgtctgtggctgggcgtggtgggtcacacctgtctcaacactttgggaggctgaggcacttggggccagaagctcaagaccagcctgggcaacatagtaagaccctgtctctaaaaataaaaatgcaaaaattggcccggtgtggtggctcacacctgtaatcccagcactttgggaagccaaggcgggtggatcatctgagatcaggagtttgagagcagcctggccaacatggcaaaaccccatctctactaaaaatacagaaattagccgggtatggtggcaggtgcctgtaatcccagctacttgggaggctgaggcaggagaattgcttttgaacccaggaggcagaggttgcattgagcccagatcttgccactgcactccagcctgggcaacagagcaagactccgtctcaaaaaaaaaaaacaaactagtcaagcatggtagtacgtgcctgtagtcccagctacttgggaggctgaggtgggaggatcccttgagcccaaaagttaaaggttacagtgagctatgatcatgccactgcactccagcctcggccagaaagagaccgtgtctcaaaacaaacaaatgtaaaaaataagtccaaattttcatgcctgagaatgatttcatcttgcactttcgcttgttgatagtctggcagacatagacttttagattgaaattaatttttgaggtcttgagtatttttttactatccatttttgctaatgggaaacaatacattccacttcttttttttcttttttttttttttctgagacagtctcttgctctgtcacccaggctgaagtgcagtggtgcaatctcggctcactgaaacctctgccccccgggttcaagtgattctcctacctcagcctcctgagtagctgggattgcaggtgcgcaccaccacatccgactaatttttgtatttttaatagagatggggtttcaccatgttgaacaggctggtcttgaactcctgacctcatgatccacccgcctcggccccccaaagcgcccatttctttttttctagatgatatgttttcttctatttgaaagttcttaggatctgtcctttatccttacaaggatgtgtctaagtgtgtgtcttttattatttgtttattgtgctgagcatttgatgtggatcttttgaatctgaagggtcatttctttctcagccccaggttatatacttccatccattatcacttcgataatttctattttttatgaacctccctattgttattaagacctcctgttaattttctcctattgttttttctcaggtttcccgtctttaattttttccataagttttgagagatctgatttttaaactgtctatggatttttttttaattatgtttaatttccaagagtattttttattgcttttttatacatactgttttatggatacaaaacttgggtctctctaaagataattgtttttgtttttaaattatttgttcctttaataatttctgtttattaggaggtcagttttgttttacttgtcaggtctttttcctccagtcctctaattctcttgtctttctccatgaataggaaatctaattgggaacagggtgtttgtggctgggcttattcactgtcaggttccacttgagtgttgagtaattaaggtcctaattctgttcctggagttgtgctaagcagttggcttcttttcttctcttccattttttttcataatttgttgaaacctcctctgctactatgtcccttcccattctctttgtagtattgagttcttaatattgcttatcattttattaaaatcttggatggaagcttgtactcaggtaatgcttgggattttcttggccgggggaaaattcaggccaaccttagtggccagctacagtgttagccatgatgtgacatgggtcctatttttcagagctccctgaagagttgttttctagttttgacacactccagtgctacttcaaactggttacggtcgctgacttgggatggcaagggtactgtctgaattctgctggattcctcgtagcttcgtggtactttgttgcctacagtggtaacccaggcagcttatggcaggagatctagacttgatacctttaccatcatgccctggatattctagctatcataatttagtctgaagactagcagtgttggcatcacctggaagcttattgaaaataaagaatcctgggcttcatcccagatcgactgaatcagaatctgcattttaacaaggtccccaggtgcacattcaagtgtgaaaagcactgatctagactttggtcagctatgatttcatgagtgaacgagactattgcatgaatcagtcctgtacttggaaatcttttcctcccatctgttttgagatgtgttgccagatctgtgcttacccattgaatttttattttcaatgggcaagcacagatagaattgcataaagagtcctagtaatccatcatagatatgagaatttttgctgcacctctatgtggtttttttttcatggtggattgagggaatttggtaagcatgtgttaatgttccagttccatgggctgtcagaatgataaacttttgagtgtctctctggtgagagtgatcatctaaccaaatccctcttctgttattgcactgtgtgtctaaggtgttgtatttatgttgccaccagctacccattatcactccattctttctgggcttatatggttgaaggagaatggtcctgtatcacagtttctttgagccctttctccatccctggccaaaagcaatcttaagttatttgccactgctggttagtggttgtcctcactcacctcacttctgtccccattatatgcctttaagttgtgcaacttggccaccaaggcctcttgactagtctgggatgacagtgctattggccattaaggaaccttggatgtggagaatctttatatatctcttcccataatgtgagggtaacttttttttttttcctcctgcagggaccccacatgggaagaactaattattggtggtgatctcaacagggccactgctctggtggcttttgtgaggcatttcccatcgtgactttgtgggcttgatggagctcctgaagttatcctttttgacatctgtcttctctttgaaatttccatctctgcattagtttatgctaagttctgaataaattcctcatcattgcctgattttaattctcaaaactatatattttgtttctaggatttacaatttatttgttttcatattcttctcttctaaacttgatttatagctaccaattctaatttctttacctttttttaagtgtacgctacttttcttttttaagaagcatgttacatatactaataatttcaaagtccttttcatattgctctatcatttctgctttcttgagacaaaattatctaattctctgatatttcatatgctttgaaaatttaatttcaaaatcatcttgaatgcaggtttattgtttttgttgctttgtttttgctttccccaacttccacttctttcccatagtttggcagataattcactcgccagccccaatttgacaccaggtatcatattagtaatgcatgcctcatcctgccaagcttttacaggccccttttcttagccagtttggctcagccttgttcttggtttggagttgtctctgttctttcttgtgactctggcaagcagctccagacagtggccacggtatttttaaactttttttttttttttttttggagaagaggtgctatatgagcccccttttttaaatggaaagacagatttcagtcccctgtcttgaatggggtgttttcagtccttatttctgtaccagaatttaatttccagctgacacatcttgtttctgatcctagaccacataggacatttgaccttagccgtcactccctgttaaatgttttgcagtcataacatctttaactacttttatgtgggtggccttttgaaaatttgtattttatctatcactgttatatatttgcagttggaatggcagagaaggggatttcacatgaacttgtttcactgtcctgaacaaaagtgcttaaattactactgtaaaaatgtaacttcttggtgttgtggaggtttactgaaagaggagaaggattagtgttaggagaccagccagggttacatcaatataatcagggttaagaagaggagatgggtttaacagactaggtagctggcagagcccttatcatagtaaaggagtataggatgagctagcaggatagaagtaggatgaaatattttaccaagttttgaatgtggtgagattgagaatatttttgtgacagccagttgaagatggtaagcactggggagtgaaataaatagcagctatacagctatatcttagcatcactggtgtatgggtagttgttgaaactataggtgtgaatgaaattaggaagagtaactagagagcaggaaaaagggggctgataatggaacttggggaccatcatcatttatacgggataaggaaaaggagagaaaccagcaaaccagaatgaagaggaggcattagagaggaagcagaaagaccaaaggagaaggatgaaacaaattcattcagtgagacacttcccagatgagagaattgtgagggtgtcgggctgcagggagtcaaataagagaagggctgcgtagtgtccctttagtgtcccttggagttggttattgaagtagaagcctgcttatacgggattagagatgaagggaagagaggggcggaccatagttgagaagcaattagggaggagaggtatttgtattttgccttcaatttttgttatgctttttaggaaattgaggaatacatttgggtacagaattttgtaaagtcttatctaattttcaattttgttgcactgatttggtgtctcaagttatttttccatgaactggcctgattttcactttttacagcattttatgagtctactgttttattttactttgccatgtaacttaaacatagtttgttcttaagattatcctaaaccatttttaaagctcagtatctagaatagtaattattaagtggccaaccaaggtggtgtgaaaggaaatcactagcaatattacatatttcttcttcattttattatttattcttatcctctcagggcagactttttttaaagtcacaaacccaataagtctttcagaggctaaacaggttctccctgatgcccagcaggtgctttaagaagggtctcatgttacctggtaaattatacaaccatttttaaatgctgtgaagttttgcagttaattaagtagtatcattttataatggattatacagattaatttattttttcaaattggcacaatttggcattgtgacaataatgcacttagtgttctaaaactggtaatgcatctccttaaacacttatttccaagggcagggatagccatagacataggtggtggcttacaggctatgttaataaggagccccacggttcctgcttaactaaaaatagtacccccagtgacttgcttgtttttctcaacctaagctaaaattttactatgagtgttccttgacagattaataacacatctagttctagttgtttctgataagagattttaagcctatattttaaataacttaacaaaaatcacatagctagtggtagaactgggattcaaaccttgtcaatctggctctgtcttatattcttaacagtataggatgttgtctttagctgtgttcattaactaaagataaaagtgggagcatgttctctgcttcctatcccttcaatatctttctcttctctctggtattcttttctagtatccttcttcattttctctttcttctttatacatttgtaaagtagagaaagatagcatataaatattcagtaaaatttttatagaagagttttctgaacaaaaatgaagctaaagtacaacagtgcaatcagtatttagccctgaggaagttaatacagagtaaaagagtttttttttttaactcagaaatgaaaacccagtaagattggctttatatagcatactcagaatgaagatagaaacagcaacttctttataggaaaagatggttaaagacaaaaggacaaacagccagagaaaagtcacaatgtgaggaaagaaacttttaaaagacagaaaaaaggttgagtatagattgaatgctctatgtcctatgacagttaaatatctgaaagtataaccattcatgaagattttataaatgccaatttttccttagagttgccaacaaaaagaggcagacagcaccagtgtagcatgctttactattttatttaaagttaatacttaagacatgattatcaggaagtatatggctttttagaccttaagatgaaaatctgttttttaatttttttatacctttcaaagtgttatatatagccagacccgtggaactacattgttgacattgcatattctgtaattattatatagatttatctcagtggatttcttccaaagtgtgatgcagaccactctttcactagtctttcaacaccagaaagaagtttcatcttcataaacagtcgaccagtacatcaaaaagatatcttaaaggtagtatgctttagaaaaaaaaaattatttgaattggaaatttgtcacattgtaacaaggactgcttccaagaatttgctctaaaataaaaaaaaagaaatacaatgtcatttattaaacattatgcatgatagaaagacatatgatgtctctcttattcttcctggcaattctggactgcattatcatccccatttatagtgaggaaacaaatgttcaatgtttctcttaggccacatagccaggaaattagagagttagtagttttttttgtttttgtttttgttcttttgagatggagtttcgctctccaggctggattgcaatggcgtgtcccgtgatcttggctcactgcaacctccatctcctgggtttgagcaattcgcctgcctcagcctcacaagtagctggtattacaggcacccgccactatgcccagctaattttttttgtagttttagtagagatggggtttcaccatttggccaggctggtctcgaactcctgtcctcaagtgatccgcccacctcggcctcccaaagtgctgtgattacaagccagagccaccatgccagagttttgatttgaaccctaagccttcagaacttccatgacattgtgatgtttaattattaagccagttttattgcatgtttgtacttgttttgaatgcttgtgcttcatttaggttcaaggcctccaaaggagtattacagataatgcttttcttttcttttcttttctttttttttttttgagatgcagccttgttgttttgcccatgctggaatgcagtagcatgatttcggctcactgcaacctccatctcccaggttcaagcaattctcctgcctcatcctcccaagtatctgggattacatgttcctgccactatgcccggctaatttttgtactttttagtagagatggggtttcatcatgttggccaggctggtcttgaactcctgacctcaagtgatccccccaccttggcctcccaaagtgctgggatcccaggcatgagccactgtgccgggtcatgataatgcttttcctaataagcagttgcatctactcaatttctcagttgaatttgctgggttttattgtactttttaattacatattattttttcttttatttattacatgtatttctagttaatccgacatcattacaatctgaaatgcctaaaggaatctactcgtttgtatcctgttttctttctgaaaatcgatgttcctacagctgatgttgatgtaaatttaacaccagataaaagccaagtattattacaaaataaggtaactcttttcagataattttttcttatgctatttataaacatatattactgttttcatataaaaagatttgtttatatttatcttttttattatttaaaatcttgtctattattttcataatttcccctaacatttgttaatttgtatttttaggaatctgttttaattgctcttgaaaatctgatgacgacttgttatggaccattacctagtacaaattcttatgaaaataataaaacagatgtttccgcagctgacatcgttcttagtaaaacagcagaaacagatgtgctttttaataaagtggaatcatctggaaagaattattcaaatgttgatacttcagtcattccattccaaaatgatatgcataatgatgaatctggaaaaaacactgatgattgtttaaatcaccagataagtattggtgactttggttatggtcattgtagtagtgaaatttctaacattgataaaaacactaagaatgcatttcaggacatttcaatgagtaatgtatcatgggagaactctcagacggaatatagtaaaacttgttttataagttccgttaagcacacccagtcagaaaatggcaataaagaccatatagatgagagtggggaaaatgaggaagaagcaggtcttgaaaactcttcggaaatttctgcagatgagtggagcaggggaaatatacttaaaaattcagtgggagagaatattgaacctgtgaaaattttagtgcctgaaaaaagtttaccatgtaaagtaagtaataataattatccaatccctgaacaaatgaatcttaatgaagattcatgtaacaaaaaatcaaatgtaatagataataaatctggaaaagttacagcttatgatttacttagcaatcgagtaatcaagaaacccatgtcagcaagtgctctttttgttcaagatcatcgtcctcagtttctcatagaaaatcctaagactagtttagaggatgcaacactacaaattgaagaactgtggaagacattgagtgaagaggaaaaactgaagtaagtttccagagcttgcatgtgacttgaatgttcagctatttccattctatatgactcactgtttaaaaagaatttttttcacttcttatttatggaaaagcagatcagaaaatacctttggcttggatagagtaccttttttggtaacactttttttttctgctaatttaggttttttgttggggcgggggcttgtattattttgttttttttttgtttaagccttaactgctttctgatattattaaattttttgctaaaggttttccattcatcttctcaatttcaaaccaccatttatcttctattttttttttgttttatgtttaataacttttctgttgtagaactttttaaaaaagcttttgcattggaacagttgtaactggtgtttttaatatcttaactattccctttcttaaattggtctccaaaatatgtaatacaacacaaaaaaatttgtattattggcgattcaatttagtgttgttcatttatactgtttctattcagtataacttaaggcttgcttctaagatgtattatttattataacttataaactatagtgggtatttttattacataaataggtgatttgatctgtctttgattaaaatagtatttgccatatttaaattagattttctgaataaatgttccaaaataatatgatgaatgtttttaattgacttaggacacttaatataaacacaaaatattatgttctggtgatctaatccagcagaaaatgagagtgaaattatacctccaatcatatacaggtatctgagtatctcaatattatgtcaaatgtgtggaaaaaattttaaacgtaatccatcatctggagtttatatttggtgataaactacctagatacttgaccaattttttttttcattctttccttagcttattcagtcttataaaaacaatatcaatttaaaatgataaagaccactattaacaccaaaatgaaaagcctccataaagcttttctcttcagccttttttgtcatctttttttttttttaagtgggaatggttattatattttgttcttttggaaatatccacaaaagtagacattttgaagtataaagccattaccccatttcaccaccaatcatctcatagtcagccctattagtcctgtttcatccatacttccattcactttctttccctttgtttattattctgaagcaaatcataggcatatcatctatttcagtatgtatctctaagagataaagatattcatattttaaacataaccataattgtcataacttttttaaaggtatagattccttaatatatcaaatactcagtgttcaaatttataattgtttcataaatgtcagatttttaaagatttgttttgaattatgatgcaaataaggttcacacaattgtgattgtctttagttttacctaaatgacacaactatgcagtttaaaggtgaggggacttaacttttaaatacagtaagcccacaaaagttgaattgcattgcccagggaaatgaattgagaattgtctgagaataggaaaaaaccatagatgtttcaagttctcatggaaatagggacagtgtacaagcttatgatggaaacttatcttgctgactgttcctttgcagcctcacaacagcaggtatcattccagttgctttttggggaatgtctgcattgtttctccttgtgggtcccaaggtgtcaggttactaggattatgattaataggcctcatctaaaaatccatttaccatcaattaccggaatattccaggtaatattctggaatcaagcttactttctctcacattgccataaagtagacaaaagaggctttgatggtcaagacctctgaagcttcacctggattctaatcacagttctttgttagctttgtatttaaaagtgtggacagtctctcatggattgttgtgaggattaaataagatattgtgtgttatgatacaagatcaattactaacacatagtaaatgattgctcacaatgtcaatatgatcagtttttaatctatgaaagggaatttttctgttgagaagaacatttctcatttgttgagtcaagattaaattgaatttggaggccagaaatagaaacctatgaagaaaatataggtatcttgggatcagagttctaattgtatgtcacagagtgctgtgttagaacctttcagagccagggttcctgggaccatgatcagctgagtctagttgcatcatgattagtgagaaggtagagcaaaaatgatacaacacccaagaatcgtactagctaccatttctcttcctgtctttatcttggagttctgtccatgatcctaaattctctaaggtatattaagagatatgagagtagacgcctcttctatagaccttcagtccatccttttcttccttcttctttttttcttccttttttccttttcctttcttcttctctcgattcctcctttcccttcccttctttcaactaggaaatattaagggttttctgcatataaggcctgaggtactctagctagtcacagataaaacatactttcccaactcatgaatggtgtaggctagtaaggaagattcagttaaacaagaatgtgatgagctttaagatacaagttttaaatataaggaattaggggaaaacttggcagttggacttaatattatctgtgggacaggtaatgcttccctgcatagaaattagccagaaggattttagggaattgtgtaggttggaggaacagtatatgagaaggcccagaagctagaaggaacatggtgttattaaggaaataagattctatgacaggaacagaatatgagggagtatgtgtaaagaaagttgggggaaggtgagggatggataatggaaggttctcaaagctataacaaagagtttgaataaggagtaggatcaggattgttcagttttctgatgagagcttgggacagattttggagtcagggagttactgacattgttttagttcttcctttctggagtttgtttgttgttttttgtttttttccttcctcgcctttcttctagtggattaaaatccagatttgggccatgtgccctaccactggggtctcactcagttgacgttagcttgaacttttcatttgcagtagttatgaatatattgctatttaaactaaaaaaaaattgcaactagggtattatgaaaatgataaactttataactaaatgcaatgtttagtcgcaagaacattatttgacttgacttctggtcaaatcaggattaatattttccattcaagttactaaatcccttcttgacattaagtacaacagtagcagctgcttttacttaacatttacttaatattcctttggacataactttttatatttcccaaagatgagtaccatatgtgaaaatttgcacattataattaattacaaatggggacctttgttttgaactcattttaccactgcacaggaaaaatctttaatttgaatgtctaagagctaaaaatactatttctaggacctgttgaaagtaaactattgaaaatcatgtgttttgtatagctaatccagaacctcagattctaagtagaaaataactttaaaattgtgaatatagcaaggtaagtaaccaaaggagccatttttttaatgtagtttacagtgaaataaggtctttttttaacactcttattcaggtaacatttcttcattcagcagacaggtactgagcacaaactacatgccatgctgtgatctcctgtcttttaaatctcacttttaacagcactgttctctcaataatatttttatttcttcacattccatatttttccttgagattattatatgcagataatgaaattcagttagtgtttgaagagtatgagactagaaataaccttaattctctagtcccaagtttaaaactttcttaaaaagtaatcttttagcaaagttacttaatttccaaccattactcgcccctttgttgtgagatttgtgtttcttggtagaaaataatgagagcaaaacatttatcaccacttactctgtgctaagtaatattctaagtacttggcacactttaactcattttatttctcacaacaaaactgaagtagatgtgtattatccataagttacagttgagcatgagacacagaaagattaaataattttcataggtttacagaactactaaatggcagaaccaagccaggctgtcttcagagtctgtgttattaatcaccacactttgctgaacaaattacagtagtttccaattctgggtatgtactggaatcacctatggagctctgtgacagcagctgcccaatctcaacctaggcctagagaattagaagctctgaggatgggatccaggtatcactttttaagaaaaggggtgacataaccgctgtgctaggtctttggccctggaagtttcatttttctcatattgttgacaaaaagatctcttaactttctacccagtgtaatttttttttattcttgagttcttagaatctatccagtataatttttcgaacatccattatcttctacctttgaaattgagttaaattagatggtttgggtgtgtttaatttatccaaatttgtcttttcattgatgactaaaatgagaattaaaaaaactaacaattagctaatcacatactttctgttttgtgattattgtagtgactataatttcactagcagttaccaaatgaagtattatatacaaaaaattttccttaatgttgttcaggaaattgtttattccatgttgatgttaaagcagatatataaggaatgcttcagatctggaattgatccatttctttattcatcctctctttttctgattgtttgtggccccacactttcttaaatggtttttttaactgggtaaaatttacctaatgtgaattgcagagatgttaatggtgtaatttgatgcattttcatacatgtgtacacacacataaacatcaccccaaacaaaatagagaacatctccatcatcccagaatggttcctcatgccacctctcagccagtctccacaggcagccactcttttgagttttgttacactagtttggttttgccagtacttgaacttcacatgtgtataaaatcatgtgatgtatactctttcatatctggcttcttaggctcaacaaagatatttttgtgactcatccatgttgttgaatctatgtgtagtagtttttttttttaaatcaaagaataatattcagttgtataaatataccaaaatttgtttaatcagtctccagttgatggacatttgggttgtttccagtttggggctattatgagtaaaattgtgttgtttactttccaaatatttggggcttttccggatattttatttctaatttaagtgtttcatggatagagaaaatgctaagttagatttcaatcttttgaaaagtaatgagaattaaagcccagtatatgttctgtcttgacaaatgttccatgttcacttaaaaagaatcaggattctgcagttgctagatggtagtgttccaaaatgtcagttaagtcttaagtaggtgataatattgctaaaatcttctatatctttgaggaatttttttttttttttttttttttttttttttttttttttgaggaggaggatctctagttctgtcagttactgagggaggagtatatactgttgcaactctggcttcttatgcttactatttgcatggtatatctttttttcagtcttttagactatcctcgtctttacatttaaagtgtagacaaagttcgttgttactttttaaattcagtttgataatctttgcctttgaattgcaatatttagtccatgtaatataataattgatatggttgggtttaggtctgccattttcctgttttctgtttgtcctagctctattttgttcttttgttcctcctttttggggggagaggagccctttagggttaaaagaatatatttcagtatctaattttaatttctttattgagtttccattagtttttgctttggtgattacattatgcatccttataatctacttggagttaatgtaaaaaccctgtaagtataatttcacttgtatttggtgtcactttccttaattgtgcacatatactggcaactaattctcatcttaatctgaaaacatctatttcatcttcatttttgaaggactttttttttttttttaatgatatagccaaattctgggttcttttgccactgaaaagatttcactgttggccaggcgcagtggctcatgcctgtaatcccagcactttgggaggccaaggcaggtggatcacctgaagtcagaagtttgagaccagcctggccaacatggcgaaaccccatctctactaaaaatacaaaattagccaggggtggtggtgcacccctctaatcccagctactctggaggctgaggcaggaaaatcgcttagaacctgggaggcagaggttgcagtgagctgaaatcgtgccactgcactccagcctgggagacagagagactctgtctcaaaaaaaaaaaaaaagatttcactgtcatctggctctgcattgctctttacaatatccattatttttgcggtttcctatttgtactgtttttttcctctttattttcaggattttatcttaatctttggttttcagcctattatacctacctgtaaatttatctaatatacctacctgtatattagatataaatatatctaatatacctacctgtaaatttctttgcatttattctctttggaggtttgctgaccttcttgcatctgtaagttgtatttctccaaatttgctgattatcaaccctaatttcttcacattttattttctttcccagttttccattgtttatctgggactccaatgacatatatattagattgtttgttttgccttaggtcactgcaatgcttttccagttgtcttcacttttctgtaaaaacaacacattttatcatttctattgatctgtcttgaactttactgaccctttcttttgccatcttttatctgctgttaagcctacccggtgaatatttaatttctgatattgtattttttaggtctagaacttccactgtattttttttataatttccactaatctgttgagattcccccttctattttctcattatgataatcttttaagaccttaaacatttattaaacctgtttttaagtggttttttggtaatcttgacatctgggtcatcttgaggttggcttctactgaccactttttcttttgaccatgactctcattttcctgttttgttagagtgataacttttgattgtatagcaggcattgtgggtgatatgtttaaaactctggattctgttatcttcttctgaaaagtgctgatttttgttctaccaggtatttaaattactgacagatcaccttgagcttgtagaggttttgttttatattttgttagggagaagctgtttcaattttgttcttggacccagggcaacttccttagtttaggacgtaggttttttatcctaagatgtggccctcttccagttttaactgaaagcccaaagtgttcacccggccatgaaactgtggaattcagattccaaactttgtttccctgcaatgggcagcagctgaaatctctgttcagctcatttagccttctaatggttgtttttctttgggttcccacacatggaattttctgggattttctttctcaattttcagttgttctggaagcagacagctctgtgtcctggtgactcaggctaataagagtgcaactttctgactgagttctggccaccctgctccccattaatactgaggactgccctctggttaaaagtcctataaatgtgggtctctatttttttcacccctcaaggagtgaatccattctaatttcttcctgcttttggctgttcttcagtgcctactttaaataattgagggttttttgtttgtttgtttgtgtgtttgtttgttgttgttgttttttctttttggtgtttttttttggtttttttttttttgagacagagtcttgctctgtcgcccaggctggagtgcagtggcacgatctcggctcattgcaacttctgcctcctgggttcaagcaattctcatgcctcagccttctgagtagctgggactacaagtgcacaccaacatgcctggctaacttttgtgtttttagtagagacagtgtttcgccattttggccaggctagtcttgaactgctgacctcaggtgatctgccaacctcagcctcctaaaatgctgggattacaggtgtgaaccaccactatgcccggccaataattgatttttatattttgttcagtgtttgtcatagttatatgcaggagagttagtctaatacatgttcctttgtcattactatatctggaacaccagtactttatttttataaaatttacttcagatggttaatatatttctgattatgatctcattagttctattttatttctattcttagatatgaagagaaggctactaaagacttggaacgatacaatagtcaaatgaagagagccattgaacaggagtcacaaatgtcactaaaagatggcagaaaaaagataaaacccaccagcgcatggaatttggcccagaagcacaagttaaaaacctcattatctaatcaaccaaaacttgatgaactccttcagtcccaaattgaaaaaagaaggagtcaaaatattaaaatggtacagatccccttttctatgaaaaacttaaaaataaattttaagaaacaaaacaaagttgacttagaagagaaggatgaaccttgcttgatccacaatctcaggtttcctgatgcatggctaatgacatccaaaacagaggtaatgttattaaatccatatagagtagaagaagccctgctatttaaaagacttcttgagaatcataaacttcctgcagagccactggaaaagccaattatgttaacagagaggtatgatgatacaatactttttaagagtaaaaatatttattataatagttcatactagattaaaatcgaaggtagaaggttgggaatgtttcctagtaaggattagtggtatttatttattttaatcttttaaacatttgatttctaggccgggcgcagtggctcatgcctgtaatcccagcactttgggaggccaaggtgggtggatcacgaggtcaggagtttgagaccagcctggccaacatagtgaaaccctgtctctactaaaaatacaaaagttagccgggtgtgatggcacgcacctgtagtcccagctacttgggaggctgaggcaggagaatcgcttgaacctgggaggtggaggttgcagtgagctgagacggtgccattgcactccagcctgggtaacagagcaagagtctgtctcagaaaaaaaaaaaaaaaaaaaaaaaaaaaaaaatatatatatatatatatatatatatatatatatatatatatatatatgatttctaatctttaatggaattgtttagaaatagtatcagaatactctagatagttcacttctacatttaataagtatgaagctcatttctctggtacattagtgacttctctagggtaattttgaagttagattgccatgtctttattccattatgtactcattgttttgacattttcaaacacataataaaatagaagtatacgatgcatacctttatcagtaattatccaagactttgccacatttgctttacctttctatacagtatatacacgtacattttctttccttcgcaaaattagtttagaacaattccccctcctatatctttcaatatctctctctcaaaaaatggctgttttctcaactaaacacaatacctttttcataccttaaataataataattccttggaatttttcctcattatctcaaaatacctttttttccagttttttaaaaaatttatatttaatttgtatctaaacaagatccacatactacatttggttatcttgtttatatatcttaaaaatcactctattattgtagattctgagtcatttgttcagtggaatgttctgttgtctgtatttgctttcttatgttgttcaacttctctcccctatgtttaattgggggttaattaaacatggagggctgaatagatttagattctattttctgatgaatctacttaataggttggctatatgcttcatatttcatcacatcaaaaggcactatcactaggttcaggtaatgacagcctgtctttcactggaaagtttcccatcaacctttccatgcaatggtgccaatcattgatgatttttgcctgaaataattttattattggttgtaatatagggtatttccttttcttattctatatgagcaaattgctttctgtaaaaataaataaccttggatgacaaagcctggggaaacaaaaataaaaaagattaaaaaataaataatgactaacctattaacatttcccttttttaacttaatatttctttttcagtcagacacaggtagaagagaatcatgacaaaaataataaaaacctgaagtttaaaaagataatttgttccctaggacacatcgttagataattctgtttcagaacttccaagaataaagcagaaatcatttataaaatgtgttaaaactcttgttaaagacactgccatcattggaggagaaaaaaacagggacagaacacagaaaaacatctgttaagtctgtctttttaaataaggaaacagcaaccacattaaccaaaatccagtatgtttcatagtattctcttgagattggcttaggaaactgtcagaggaacaattagaaaatagtgtcttaggctacattcaaacagtttaaacatctgatggtgcttttctctttcttacctaaaagagctagggtacatctgaatttttagacttgactgcttttctgaatggcattttgtaaacttcatttaaatttcaaaaatctttttgagctttttcaaatgataggtttttaaaaatatttttctatgtgatgttctgttcttcaaaaaacaaatacattaaaaactattattgtgggaccatattggcctgaaaaaaaaatctttcttaattgagcataaacaggaataaagattaattcaaaatagtttttcctccttcttttggaatgtggcatccccatcacagttaatgatgtaagtttttcaaaactgagtcagggactagtttatcccacaatgcgacaatgtgggcagggtaattgtaggttgggctcagttttcttgccagagttctaatgctgtttgtgtaacttacctctaagtggaataatttaggtacctataaagtaagggctcaataacaataaccttaatgatggctaatatttattgaacatttactgtatgataggaatttggcaaagttttttcatgatcttcacatcaactttatgaggtagataatatccacattttatagctgaggaaactgaaatgtaatggttaaataacttaactaggctcacacggacagtaaataagctgtatgtccaagattacaatctagacagtttaactgtggagcctgcaccattaattgctatacagtatcataatcatcaccaccaccaccatccctactgtctctcagatcgatttttaggatattggttagatgaaacagagtacatgtgatatatagccaaagctctcttctctataatattagctctcacagccattggggtcttcaaccattcagagctgataagcaaagatatcagcgtactggaacacagaacagtgccttgcatacatacctaggacaatatctgccacaaggtaggcactcaaatattcattgaaggagtggcaagatggtaactattcacatcaaccccgacagacacctttttgcaatgactataacgcgtcctgaccaagcctaaaaccaatatgtgtggttgatttgtaccctaggtgatctttggcttcctcaagtttttgcaccactcagaatcatttcatataccacctttggcaaacatgccagacctgcagtagactgaaggaagctctcccaagctctaaattgattaatttattagttcctagaagaaagagattacatgtttatctttttgttacagaagaaactttgaatagcagttgaaaatttggcagggtggaccacctaacttgacagtgtattattgtgtctgttttgaaggaataaaatggaattatttataaagttttcatttgtattagagagagccatttttaaaatttcacattcaatttgtaacattctagaagacagattatcttctttctgtatactgtgtgcagtaggtatttaataaaatattaacagaaatgtaaaacagtgatttctcatagggctacttatacctttgtattttggttaatgatgataacacttgtcaaagggccctaggattaactttttcccgtaaacccccttattttgtgtttttaataagttaaagggccataatttctttttcagtctttttaatggatctcattatttagacgttttatataaaatgacagcagatgaccaaagatacagtggatcaacttacctgtctgatcctcgtcttacagcgaatggtttcaagataaaattgataccaggtatgatagtgtggtttaatattttctgatgtggaaaaattagtcttgttccaagagttacatttgggtttcatgatttacagatatggtggtatatttttgtctcactataagtacagtgtcagctatgttaaaacatttttttcaaaacatcacctctgcctgaaacaagtaagtttggcatctctttcagtccaatgctttgcatttgcattttcataactaatcaaatagttttattgtaatttttgtcatcctttgacacaatattcaaactgcctgctttgtttaaattattaaaatactcctttaaatgataaaacacaaacatgtaggatattggaattgcctaacaaaaatggacatctttgcttttcaaaaaacatttgcttgttttgccaattagacgtgtaacatcagcagttgtactatatggagaatggatgatttggttccatggctttggtaaaagactgataaccctctttgctcagtatggaaattcattgggtggatttaaaaagaaaaaagaaaatccatctggctagagacttcagttttcctggctggccccttctctgttcctttatagtttccatactcaactgccttctgccctatcttctgttactttctcttcatctggtatcagagaggtacattggaaccatgaggaaggactccactgtctcccttcctgcctctaaacttgtcatgcccaaagtatagaaaaacagagctcgaccaaaatagtgtttgaagatttttaaaggaatgctttactgagatatgaaaataagtaaaaacaatgtacaaaagcatggagctgggtatatacagaaaatactttggtgtcccaaacataaactaattttacttgatttttgtgatttttaaggatacctaacctaagcttcttacctcctacctcaattctattagtccaaatcccagcactgccatttaaaaacaatgtgttttggggaaagtcacctggcctcactgtgtcttcattgaaaacaactaataattattgaataattattatgtacagggcactattctaagtattaaatgtattaatttaatctccctaatatccttgtaaagtaggttctattactgtccccattttacagatggaaaaattgaggcacagaagttaagtttgctcaaggggacacagttattggtaaaaccagaatttgaacctaggcaatctgcctttaaagcctagctcttaactcatttattatattgccttcctgtcaaaatttagatatttactccaggaagtattggtgagcattaaccaaagtaacaattaaatcagtgagcatggtacttggcaatgggagatgctcacatattctcttttcttaccatccattagccccctttagcaggcttgcagtcatctgttttagtcttcctagaaatatttcttgctcagggtccctggcatcttaaaatttatgtgaagtgaatttacttgaagcaagggatgggtgggggtatatgtgttttattctcaacttaatctgtttttctaattatatggcgttggtggcaggtactggtttttttcatgaaagatattaaacaggccaggcacggtggctcatgcctgtaatcctagcactttgggaggccgaggtgggtggatcacctgagatcaggggttcaagaccagcctggccaacacggcgaaatactgtctctactacaaaatacaaaaattagccgggcatgtggcaggtgcctatgatcccagctacttgggaggctgaggcaggagaatcgcttgaacccaggaggtggaggttgcagtgagccaagatcacgccactgcactctagcctgcatgaccgagtgagactccatcttaaaaaaaaaaaaaaaaagatgttaaactgcaggttgttgttgttttaaggataactgtcctttcttacctgccactcaattccaagagcatttttttttaactacccagtaagtttatatctcacagatgctttcagctcttagcttgtaagtagtatttttttaaatcttattgaatgcctaatactttccatagcatcaaagatgcaaaaatgattaagtcacctgtaaactgacttgatttgattggaattaactttacttagattatcatcagcattatttcccttgtcaataacagagcaagttaaagatatttatgttttctttcttcatttctttgtttttttatttttttaattaggttgtattttcttaacagttctgtcttgtgtgagagtattgtattttactaactttgaatcaacagtttgcctgtagtcacagtacttctttggataaggataaaaacatttgaaagagaaggaatacatctggctttgagagagaagattctcaatgtgactctaagaactttgcatgctaataggaatagctttttgtcctgcatcaataagaattccatattttaggaagtgaaaacttgtcaaaccacttactcatttgatgtattttccctgaaaattggtaagcatttcacagtattttatggaaacttttcaagggttattgttacatagttccaatgtctctaacttttccatatctgaattttacaaacacagaagttaaaatattgctcaatttccttattcgttgccaagtaccttttacccatttccactagtaattctgtgaaatgtgtatcattttccagggcaaatgtagttagtattagacttttcattctaatcatactgtaaaagatttaaaactaccaatagtgaaaaatcacttagactgatatttttggcaattttcatatctatataaatagttaaaagagatgtgaactagaatattctgctactgctttttgcctaccacacacagttttgagtttcatttacgtttcccctattgctcaaactcatttcgtttccactgttagttcgtttgtgtttctataaaggaatacctgagactgtgtaagactcaggtagacctgagactaaaagaaatgaccacaagccttccttacaaagaaaagaggtttatttggctcatggttctgcaagctgtacatgaagcatagtgccagcgtctgctttccttttacatataagttccaagtttaagtcatttctttgctctgatggtagccatgccacttcttgaatgatttgctgcttaggaacttctttcgctagatagtgaaattaaatagtgatgacctgggtcatcactcttaagttcaaacttctaccgatcctaagggcagaggtgtccaatcttttggcttccctgggacacattggaagagttgtcttgggccacacataaaatatactaacactaataatagctcatgagctttaaaaaaaaaaattgcagaaaaaatctcatgatgtttaaaaaaatttacaaatttgtgttgggctgcattcaaagttgttctgggccacatgtggcccacagaccacaggttagacaagcttgccctgcggcatggatacagtgcagccaaaatccttgcggggacataaaaaggatgacctttactccagtttccaataaattcctcaatatcatctgagactttgtgagcctttcactctgcgtatttctatcagcattttagtcacaaccatttaaccagtttctaagaagttctaaactttccctcatcttcctgtcatcttctgagctttcaaactcttccagcctctgctcttacccagctccaaaaccacttctacatcttcagttatctttatagcagtgccccactcctcagtactaattttctgtgttagtttgtttgtgttgctataaaagaatacttgagactaggtaatgtataaagaaatgaggtttatttggctcatggttctgcaagctgtacatgaagcatagtgctagcatctgcttctggtaagggtctcaggaagcttacaatcatggcagaaggcaacaaggagccagcatgtcacatggtgaaagagggagcaagagagagatgccaggctcttttaaacaaccagctgttgtgtgaactaccacagagacctcactcattaccatggggatggcaccaagccattcatgatggatctgccccatgacccaatgcacctcccactaggcccacctttaacagtagaggtcacatttcaacattagatttggaggggacacacatctaaaccatagcatctcacttcattgaactctgtatctcatcccttaatgcttgataatataatattatatattattctccagttgttctctgggaaaaatgtttaggataccatctctgtagtctaccagcattgcatctgccaaccaggtcaaggatgtagtctgtaattgggaacaggtaagggattggattattgaagtctcaggatctgaaactcttcaagttatatcacatctctttttttaaattaatccattgatagctactacttatccaagattggactgtctcttttcctttaattccaggtagcattatgtagacttcatgaaagaacactgttacaccgatacagccaaagaagacacatctttgctatgttccaaaaatatgcattctaaagccaaatctgatgctttgaaatatgtgctgttatggattatgtacccagttatacatccaatcctttagctagtttctagttttattttattttattttattttttgagatggagtcttgctctgttgcccaggctggagtgcagtggcacgatctcagctcactgcaacctgtgcctcctgggatcaagtgatcctcccatctcagcttccctagtagctgggactacaggcacgtaccaccacactcgtctaattttttttgtatttttggtagagacagggtctcaccatgttggacaggctggtctcaaactcctgatgttgtgatctgcctgcctcggcctcccaaagtgctaggattgcaggtgtgagccactatgcccagccatttagttttattttaattactaagagtaatttaagtaacagttaacatgtcagttttatttgtcctattaaaatattttgaacaaacagtattttcttctaattaataatatctccataaattactatgtgactgcttttataattcgtaagttaaaatcacagaaataattcaggcgtttagatattgaaatggtagggtagaatttgaagagcagcagttgttaaaacacttaaaccagttttattttcataaatatcatgggactccattttctctccaaagcaagaaatgatctaaacaaatttaaggaacagaacagcaataactgggattaagttaaattatataaagcacatgtggtgtcagtgagcacttatgacttaatgtgagaccctatgggaaattactatttgttctccaactaaggaacaaaactttgtcctgactgtattaaatttgaatgagggttcactaaatgttttaacagcaatttttgtttttaatggacatgttctggaatatgaacttaactatgtgtttttattttttttctttcaggagtttcaattactgaaaattacttggaaatagaaggaatggctaattgtctcccattctatggagtagcagatttaaaagaaattcttaatgctatattaaacagaaatgcaaaggaagtttatgaatgtagacctcgcaaagtgataagttatttagaggtacgcattattttatatatatgttattgtatacaggggtcccaactcccgggccaagccggttaggaaccaggccacacagcaggaggtgagcggcctcctagcgggcatcaccacctgagctctgccttctgtcagatcagtggcagcattagattctcatggaagcacaaaccctattgtgaactgtgtatgcgagggatcgaggttgtgcacttcttgtggaacaatttcctgaaaccatccccacccgccaactggaaaaactcttccacaaaaccggtccctggtgccaaaaagcttggggactgctgctgattctatatatagaggtattatagattggccagactttaagatacttatttcttaaaatagtaaattatttccaaatagtagaatattatctgtaagttttattatgtatttgcaagaagaacactattaaaaaaaaaaagaacactctattaagtttcacatcatagactgactgtggtaaactctatcatggattcttaccataacattttcttgggtacatattgaggaaagactttataaatgagatattttgcagtgaagttcttttttaaaaacatttcataaataatcccctcagaaggggtttaaactaatgctacctttatattacatacttgtctaaaaagtattgtaatataattctaagtcctgatctcatcaagaggagtagaagggaaggaaagtgaaagatgggaatctttgaataagcggaaattttcatttttgtgacagtattcaccacaaaagagaaatgtaagagtgggttaaaagaaaaggattaaggaaggttataaactttaaaatataagatagtagcaggaaaacaatagtgtttccatctatatatcttgttctagatatccctcaagattggtattatttaaaaaacaaacctgaactctaatgaagtttttctccctttttaaaaatgagccatttttgtttacagttggtagtgtgcctgctgtattctgaaggtcggacttccttaacaggaaagtctgcttgttaaaccttctgaagaatgtattcagtaatgttctgtgaatcctttaggaactttgtcatgtggaaattcccagcctattgtgcgggtagcttaacattgatagtttctagagacttcaagggaatattttcttgtgaaagagttagtatgaacttaaaggttgagggagctgtgggttggaagaaccatgtggggagaaataagagttcagaaataacaggaataaagtaaattgggactggttttaaatatttttttgctaatactttacctttcagtatgttaaggtaatagtggtataagtgttaagaaaaatgggctaggaaaaaaaaagagagaacttaaaccacggggatgcttccatttaaggtcaataagatgaatcagagagaaaggaaagtgaaaggagaaccaagagaggggtggatgtaaaagtcaaggaaggaagtaaatttaagaataagtagtatcatgttctgtatagggtaataattgctagaagactatcagatatggctactagatgacattggtaaccttgaagagaatcgtaatggcaaagtacaattgtccttgtatatactcagtggattggttccagcaccacctgtggatactaaaatccaggcatgcttaagtcctgcagtcagccctccagaacccacatatatgaaaagttggccctccgtatatatggatttcgcatcccatggtactgtattttctatcacagttggggtcggaaaaacatccatgtataagtggacccacacagttaaaaccagtgttgttcaagggtctgctgtggtaggaatagacgacatttgccagtagttaaagagtgtagtagtggaaaagtaggcagcaagtcgtatgatagtgaatagtgaaaggaaggaaagagtatgttaaacatgtctgtgttgaactggtggaagactgacaataaaaaattgcagaggaggccaggcttactggctcatgcctgtaatcccagcactttgggaggctgaggtgagtgaatcacctgagatcaggagtttgagactagcctggccaacatggtgaagtcccgtctctaccaaaaatacaaaatttagccaggtgtggtggtgcgcacctgtaatcccagctactcaggaggctgagtgaggcaggagaactgcttgaacccaggaggtggaagttggagtgagctgaggacgcacactgcactccagcctgggcgatagagctagactctgtctcaaaaaaaaaaaaaaaaaaaaaaaaattgcaggggaaatgttccccaaaaggcaagagggaagataggatatgaatttaaggtttagaaagaagaaactgaatcaagagcagaaaacagaaaaggggaaaaatgaaaataatatttttacgtaaactttaaaaaaaaatttcttaatcattagaacctgtgaaattttaggggaacttgagagaagtcatgttgatatatgtggtgaaagagtagaagttacctgctgagagtggaggggttgtgggaaggagttggtaattttagtacagtaacaaagatctgaaaataagagctgtaggtactataagagaaggttaattagagaggaataagaagatttccaggtgtcactgagggatcttaagagttaacatttgtattggatccagccaggacagttttatgactcaacgatgctcagtagaatttgtccaagggtaaatcaaaacaccaattcctcaccctgtcctagagggtgatctggcctctgcctaatttccttttcttgttcctcttttttttaacaactatgatgcacccacactgaacatttagttctttctcttctgtctgcgtgagatgcttttctttgcccatgatctttccattaaggtttcttatttattaatttttatttatttattttgagacaaggtcttgctcaaaagctggagggcagtggcatgatcacagctcactgcagtcttgaccttcaggctcaagtgatcctcctgcctcggcctcccatgtagctgggactacaggcatgccccaccgtgcccacttttttttttttttttttttttgtggagactgggtctcactgtgttgcccaggctggtctcgaactcctggcctcaagcagttctcctgccttgtctcccaaagtgttgagattacaggcctgagccactgcacccagcctggttccttatttaaattcaagcttaaagtcatctcctcaagtaatctttttccaactctacaatcactctatcatgtggcccagtttaattttacgcattatttattgactaaaatgttctgtcttttgtctgttttctgtttctctgcactagaatgtaaattgcacaagagcaagtcttgttttttggttcaccactacatcccgagagctgacaacatagttgatacttaataaatatttgttgagtgaattcataaaatgaaaataatcaagattctgtcttcctttttgccaggataacatgttttcagcttcagggtatatcatggtaaaatgtgtgactttccctttggacagggagaagcagtgcgtctatccagacaattacccatgtacttatcaaaagaggacatccaagacattatctacagaatgaagcaccagtttggaaatgaaattaaagagtgtgttcatggtcgcccattttttcatcatttaacctatcttccagaaactacatgattaaatatgtttaagaagattagttaccattgaaattggttctgtcataaaacagcatgagtctggttttaaattatctttgtattatgtgtcacatggttattttttaaatgaggattcactgacttgtttttatattgaaaaaagttccacgtattgtagaaaacgtaaataaactaatatagactattcatttgattctcaagaaccaaccatcatcataattatgagttgtaggctcaaaattggaaaataggtagtatttttgggtggttatttactaggtcctctgtgcagggagaaatcaaacatcacacatactggcatatctgacaaacagtgtcaatattttttaaagtacaatggagagtcagagtgggagaaaatgagaaaacgaagtttagaggaagaagaaaaccagaaatccttcctttaacttcaatttagggggtaacagattagatgttgctgtctctttattatatggtaattattggatttgggggtcaacttttgttggaatacatgggaagacctagatttttaacagaaaacttaggggaatttttttttttttaagactctcgctcttgtcacccaggctggagtgcaatggcacagtcttggctcactgcaacctccacttcccaggttcaagcgattctcttgcctcagcctcccgtaactgggattacagccgtccaccccacacctggctaatttttgtatttttagtagagatggggtttcaccatgttggccaggctggtctcgaactcctgacctcaggtgatccatccacctcagcctcccaaagtgctgggattacaggtatgagccgccacaccgggccattaggtgaaaattatctattgtacatatgccctttcaaaaaccaggtcccacagtgcaccaaaatacctttataaaaagttgaaacatgatttttaatgaacatatttgttgtgtaaaataagacatgttattctggatacgatgtccccacactcacaccatctcccataactctcaaagatcatctttaaattcctaagatccttgtgttaagtacaaattgtgaaacctggattctgccttttcttctgccaatatcatcctattttgcatgacccaaaatactgcttcccctgactctccatttccccttttataaatgtgaggtcctgctctgggagagctttctgggagtaatccttttaaattaactgggtaaactgagggaagagaggctcacagaagctatcaaagatgaaatttgcatcatacatttgcactcaccgtaagtaaaactgtagactcattttttagccaatatagtctgtactggtcttacaactatcttgtagatgaagaaactcatttctcaccagttatgaattgtgtcaaagcaggttggtaggaatggcagtaggtatttaccacttatttgctagacaggttaagcacttaccttggctaatctcatttaatgttcacagcgaatttaaatttgtagttactgttgagattctaatcccagagctcctgttcttaaccaccattatactgcctgccatgagaaatgggccctaaagagttatttgggtcaactaaacataggtagttagggagtataaaacactccctgacaccactttaacgaatgctggagtaaatcaactttaggatgcaactttttttttgagacaagagtctcgctttgtcgcccaagctagagtgcagtggggcgttggcttcctgcaacctccggctcccaggttcaaacgattctcctgcctcagcctcccccgagtagctgggattacaggcgcccgccacccgccaccacgtcccgctaaattttgtattttttggtagagacggggtttcaccatgttggccaggctggtctggaggtcctgacctcaagcgattgccccgcctcagcctcccaaagtgctgggattacccaccgcgcctggccggcaacgttttcctaacggtgactggagtagcagactggcgtgaacaggaatgggcttcaggtgagggtctagcgttgccccacggaccaatcctggttgacgaggctaagggaagcctagcaaccacgcagaagcccggcaatcttccgcagcgctcccatcctccacaagtccttacaacagccccagcaccacccgcgggaccaaa

SEQ ID NO: 40 - DNA, 42868 bp, Homo sapiens
cttaaataagtagcaatgagaatgtaactgagtaatttatacaaatagggaaaagggaacacaggttgaaacactttattttagcttggaagcacgtccatggggccaagtaatcaattccacaaatcattttcttgtctttttttttttgtcctggagacagggtctcactctattgcccaggctggagtgcaggggtgtgatcatggcccactgcagccttgacttcctgggctcaagtgatcctcctgccttagtctcctgagtgcctgggactacaagtgtgtgccaccaagcctggctaatttttaaatttttttgtagagacaaagaactgcgctatgttgctcaggctggtctcaaactcctgtcctcaagccatcctcccacctcaggtcccaaagtgctgggaagacagccgtgagccaccacacgtggccaggccaccattcttcacctagcctattccacctcgcacccattctagtccacccctgcaaaccatcctttaagatggcagctggaaagacttaaaaagaaactcaaggctgggcgcgctgactgatgcctataatcctagcactttgggaggccgagaggggcagatcacctgaggtcaggagttcgagaccagcctggccaacatggtgaaaccccgtctctactaaaagtacaaaaattagccaggtgtggtgtgggtgcctgtaataccagctattcaggaggctgaggcaggagaatcgcttgaacccgggaggcggaggttgcagtgagcagagatcacaccactgcactccagcctaggcggcagagtgagactgtttccaaaaaaaaaaaaaaaaaaaaaaaaatcagatattgtcaatgtctcccccttgctaacctgctaggtgcttaggataaaatgtcaaacatttaacatggcttcacagacattttgtatcatttggcctctggctaccttacctcacccaatttcgtcctttgcctgtgctctagccacactgtccgaggagttcctaaaccaccaccctggctctgaccacagatcttcacatgtgctgttccctccatctgcatcactcttccttcttctcttgtttgcttaactcctatttaccttcgggcttaatcagcactttctcacctctcctagtctgctgctcttatttaagatcaaacgtcagagaaatgtgaagtccactgacttccgggtggaacagagttcagtatgccaattaaattattgagtgctggctaggcacagtggctgatacctgtaatctcagcactttggaagggcgaggcgggtggatcacttgaggtcaggagttcgagaggacaacatgatgaaactccatttctactgaaacacaaaaattagctgggcttggtggggggcacctgtaatcccagctactggagaggctaaggcaggagaaaattgcttgaacccgggagacagtggctgcagtgagctgagattgcgacattgcactccagactgggtgacagagtgagactctgtctcaaaaacaaaaaaaacctcggtcaggaatgaagaatgtctgaagtactgtatgtgtaacgtggcttgtgatttttaagccctgagtgcagcgtgatctagtccttcgtgatctgagtaataacaaaatgttcaagatctgttttatgtcattcgtgtcttctaatgttggcctgttgttttccttgctgagactagactgtgatgtggtatactgtttttctccattagttttaatttatatgtatttataaacagcttattcttcatgttgctttcatttaccctggagatacttgattgctttttttcttttttttttttttgagacagggttttactctgttgcccatgctggagtccagtggcaggatcacagctcaatgcagccctgacctcctgggctcaagtgatcctcccacctcagcctcctgagtagctggaactacaggcacatgctaccacacctggctaagttttgtactttttgtaacaatggggtttcaccatgttgcccagattggttttgaactcctaggttcaagtgatcctcctgccttggtctcccaaagtgctgggattacagacgtgggccactgcgcctggccaagatgttttatggctaattatttgtccgcattgttatcacctcctagagaaactgctagaagagtgagattatgtgtcctctaagttcacaaaaacccaaaagaagttaggcagcagacttaaaaacaaataaaacagactctgcaaaacttggccttaaatgaaaggtgacattctccaacctggattgtctttttggcttcatgggactgtgcagttggagggtgactgggccctgtttccacggcactctctaggtgcagggaccattgaactatgtctgctatttctgtcttagctctgtactgaaataacagttgtgttattgggtttcaaaagaaagtctgtccctcctgatctaggcagaaagccattaaagaaaacagaaggataacaagcagtgggaaaacagaccagaaaagttaccgattcacccatcttgtgtcagaaatggacaggcctgtttctcctgctggaaacctaggatgtacgtttgcaatgagaaaagagtgaaagacttgagcaggtacattacaaaagcacaatcacagcggccagtgaatatgaaaaggtcctcaagttagagaagtctggagaaatccaaactaaaactaccttaggataccacgctacacccaccagctttgggcagggtgcaaacatcaggaattcttctaccctgctggtgagcggtgagcgagcgcataaaccagtataactttggaaaacaatttaatagagtggaaagccaggcgggccgctgagccagcagtcccattcattagtacataccccatgcctgctcctctgtataagagtattcactgcaggactgttcatagcaagttaaaatggaaaacaatccagtgtccctgagcaagcaggatggataagtatatggtggagagtcatgcaatagaacggtatagtacagagatgatgaatacttctgatattacaataaaatgactcctaaaataatatctacgaaaaagaagccagggctgggacccagtggctcatgtttgtaatcccagcactttgggaggctggggttagaggatcgcctgtggccaggagattgagaccaccttgggtctccataaccaccttttatgtagagatgtggtaagacctcatctctacattaaaaaaaaaaaaacacccagacacatcagactatacgctgtatgcttacctatatgaagactattgtttaggggccgggcacggtggctcacacctgtaatcccaacactttgggaggtcgaggcgggtggatctcttgaggtcaggagttcgagatcagcctggccaacatggtgaaaccccgtctctaccaaaaatagaaaaattagccgggtccagtggacagcgcctgtaatctcagctactcaggaggctgaggcagagaattgcttcaacctgggaggcagaggttgcagtgagctaaaatcacaccactgcactccagcctgggtgatagagtgagactccatctgaaaaaaacaaaaaaaaaaacaaaaaaccagactatattgtttagggataaatagttgacaaaataatagagacaagcaagacataattaccataaaaatcaggacctggggttgggggtggagagggaaggtttaagtggaaagaatggagtggtgacaatgtgtgtcaacctgggccatggtgaccctggggttcgctttgtaattcctcaaaatgagcatttatgtgctattcacttttcagagggtagaatctctgaaccaaaatgtttaagcaaccatatattaaaaaaagaaaaaatatggacagatttgtattttaattaaaacatttaaaaaatagagacaagggtctcgctatgttgctgagagtggtctcaaactcttgggattcaattgatcctcccgcctcagtctcccaaagcgctgagactccaggcgtgaaccaccgcgcccgacctggaaagatacatacatatatatatatatatattttttttttttttttttttttttttgagatagagtttagctcttgttgcccaggctcgagtgcaatggctcgatctcagctcactgcaaactccgcctccagggttcaaacgattctcctgcctcagcctcccgagtagctgggattacaggcgcctcaccacacccggccaatttctgtatttttagtagagacgaggttttaccatgttggccaggctagtctcgaactcctgacctcaggtgatccgcccgcctcggcctcccaaagtgctgggattacaggcgtgagccacggcgcccggcctggataaatcttttaaaacataaaagtctgagtgagtccctggccggccggcacagatgccggggtggggccgtgaaccggttgggacgcgctcgctccggcctggggggacccgggccagcagccggtcgccgcgcgtgcgcactgggcggggggccccgcgctcctacctgcacgtggccagcgcccggcgctgggccgtagctcctgccgtgcacgttggggagccggtacatgcaggtgggaagctccacacggagaggcgcgccgcccccgtgatagggctttacctggtacatcggcatggcagaaccaaagcaaaagggggtagcgcgtgccaaaggccaacgctcagaaaccgtcagaggtcacgacggagaccggccacctcccttctgaccctgctgcgggcgttcgggaaaacgcagtccggtgtgctctgattggcccaggctctttgacgtcacgaagtcgacctttgacagagccaataggcgaaaaggagagacgggaagtatttttgccgccccgcccggaaagggtggagcacaacgtcgaaagcagccaatgggagttcaggaggcggagcgcctgtgggagccctggagggaactttcccagtccccgaggcggatcgggtgttgcatccatggagcgagctgagagctcgaggtgagcggggctcgcagtcttccggtgtcccctctcgcgcgccctctttgagacccacggcattccaacctccctggaaatggggggaacatggccgaggcgcgtggcgaggcagccccctggaggccccggagtggcgacctcagtgttgcagcgatctcgtgccccttgggtgcgccttgaggccgaggcaagctccttcggggtcctgggctgcgggcaaaggattcggccctgtgaggagttgggttcggcctgtcccagacaggccttgcccacatcccatcacagggccgtggacttgaagcgggagcgtgaaatccccatagactgaatgcatttcctttctacctgttctctctccccttttatttttatttttatagtattttatttttaatttttttttgtagagacggggatttcgctgcgttgcccaggctggtctcgaacgcctgagctcaagcaatccgcccgccttggcccctcaaagtgctggaattaaaggcatgatgcaccgtgcctggcctttttaaaaaattaaggttattttggggacggtagagcgtccagacacatccttatttgcatagctgcgcagtttttaaaaatgcaatacgtttctacctgttaggatgtgtgatttctggctggtaagctacaccgaatcttggctagcacatttgcattccatgtcagatttgtaaacgcaaatttgctctctgcatttaaatatattagatatatttaggtaactacatttaaatgtattgagacatttaaataaatttggggtctgtgtctaaatgcgctccctcctcaaaataaatatctgaagtgggccgagagcggtgactcacgcctataatcccagcactttgggaggccaaggcgggtggatcatgaagtcaggagttcatgaccagcctggccaacatggtgaaatccgtttctactaaaaatacaaaaattaactgggcatgatggcgggagcctgtaatcctagctactttggaggctgaggcaggagaatcgctggaacccaggaggcggaggttgcagtgagctgagatcgtgccactgcagtccggcctgggcaacgcagcaagactcggtctcaaaaaaaaaaaaaaaaaaaaatcagaagtggacctgtagcctatagtgtgctgccaaataaacttatttttagagatacttctttccattttctgtgaggtcatctgcagtttcacatggtagacagacttaggtgagattcttagcaaggtggaatgaagagtaaagaggtttgtttatttcagaagggtttattaaaggcctacgatgtgttaaatgctgtaggaaatacccagtgatttctctttcatggaggtttcctgccttctcttaacaagttatcaattaaactgtttgctggaaattgctaagttaatgaacacacgggatacattctttgagcagacattgtttgggcagaggaggaagaggagagcggtttagacagagacctgcttatacactgtagtgtctcaaagagcttgtgatgttcaggacagttgttcactgtgctacaatataggggatggctggttgcggtcccctgtaatcctagcactttgggaggccgaggcaggcggatcacctgaggtcaggagttcgagaccagcctggccaacatggtgaaaccctatctcttctaaaaacacaaaaattagctgggtgtgatggtgggcgcctgtaatcccagctacttgggaggctgagataggagaatcgcttgaacctgggaggcggaggttgcagtgagctgagctcatgccattgccctctagcataggcaacggggtgagactctgtctcaaataataacaataataacaataataataataataataataataatgtaggggacttgatgaagggaaaggattagagagattctgaaaagaaggtagttttggccccaatgatgactaaattttaactttcatatagtaggaagtggggcactagtaaatttttaagcagaaaaattatttgaccagatttgtgatttcaaaaatagctctggtgatagagtggaggatgtattggagcagggaataaggggagataaaacctttataaaactcttaaagctagtacagcaagagctttgagggtctttgctaagacagcagctggcagcttcagtttggagtggggtatcaaaggcaactgtgtataaggaatagttatataactggtacccaatttctgagatgattttgacttaaacattgtgtatttcccagcatactgttggtttttctaattatgttgggaaattatgttactttcatttttttttttgctcgttgcccaggctggagtgcaatgccgcaatctcagctcactgcaacctccgcctcctggatttaagcgattctcctgcctcagcctcctgagtagctaggattacaggtgcccaccaccatgcctggctaattttttgtatttttagtaaagacggggtttcaccgtgttggccaggctggtgtcgaactcctgacctcaagttatccacccatctctgcttcccaaagtgctgggattacaggcatgagccaccacagccagccatgctttcacttttcaagaaagaagacaccattgttgccaaagattttggtaatttgagagatacaatgtatgttttctccatgtggatcttagtataattagatagtaaggatctgttgaatttgaagtatctatccagaagtattttgggtacatgtttaaggattgtaaaacagtgtttctatttctggatataataaatgtatttgctaatataataaatgaatagattagacccataaattatttacagtgttgagtcatttcccacagttaaaatcaggatgaaaatatatagctgaatacttgatttgtttcttgtaactgatttctctagtacagaacctgctaaggccatcaaacctattgatcggaagtcagtccatcagatttgctctgggcaggtggtactgagtctaagcactgcggtaaaggagttagtagaaaacagtctggatgctggtgccactaatattggtaagtttgggagagttttaagccacaagaaatgatctgtgaatgttgttgtagttaagaaacatttgttattgaaataagactatcaagtgttgatgtagtaataaattattatttttaagttgaagttagcacctattatgtgcctagtacttagctaggtagtaataataataacagcttttattgtgttcttacggtgtgccaggcaggtgttatgctaagaattgcacagaaatatttaatttgcagaacagctgggcgtggtgtctcacgcctataatcctagccctttgagaggccgaggtgggggaattgcttgaggccaagagttcaagaccaacctggccaacatggtgagaccttgtctctattgaaaaataaagtaggccaggcatagtggctcacgcctgtaatcccagcactttgggaggccaaggcgggtggatacctgaggtcaggagttcgagaccagcctgtccaaagtggtgaaactctgtctctactaaaaatacaaaaattagctggacctggtggcagaagcctgtaatcccagctacttgggacactgaggcacgagaattgcttgaagccgagagacggaggttgcagtaagccgagatcgtgccactgcatgccagcctggggacagagcaagattccatctcaaaaacataaaacaaaatagggctggagtagtggctcacatctgtaataccagcactttgggaggctgaggggggctgatcatttgaggtcaggagttctagaccagcctaaccaacatgatgaaaccctgtctctactaaaaatacaaaaattagccagatgtggtggtgcatggctgtaatctcagctcctcaggacgctgaaggaggagaattgcttgaacctgggaggtggaggctgcagtgagccaagatcgtaccactgcactccagcctgggtgacgagcaaaactccatctcaaaagaaaagaaaagaataataaaataaaaaaaaccaaagaattattaatctgcagaataactttatgagatagaacttattattctctattttacaaatgaggaaattaggggataggaaatttcctttttttgagattataaagctgataaaataggatccaggaagtctgattccagaacccattctctttttttttttttttttgagatagagttttgctcttgttgcccaggctatagtgcaatggcacgatctcggctcactgcaacctccacctcctgggttcaagtgattctcctgcctcagcttcctgagtagctgggatgacaggcatgcgccaccaagcctggctaattttgtatttttagtagagacagggtttctccatgttggtcaggctggtctcgaactcctgacctcaggtgatctgctcgctttggcctcccaaagtgctggaattacaggcatgaaccactgcacccggtccccgttctctttattgggtatgttaaaattatttctttcaaaagaaaaggatggtcaaagtgcaacgcggtttacagctaattgatcaccaccagttacagattttttttgttccttctccactccaactgcttcacttcactagcctagggaaaaaaaaagaggaaagaaagaaaaagctaaactatttagtctgggctagtaaatagccagaaaggactttataacaatgaaatatacaaaatgacactagtatgtttaactaaaggtatagttatgactcttaaatttgcatatgttataaataatgtcaatataaaaactgatagcatgggtccgtttttaataaatatgtaaatattttaaactttctagatctaaagcttaaggactatggagtggatcttattgaagtttcagacaatggatgtggggtagaagaagaaaacttcgaaggcttaagtaagttgactttttctaatcctattataaaataattgggtcacatgtctcagaattttgagtaacactgtcttgggaaatgcaaaaacagttttttaaagccagttactagatatcatgtatattttgttgttatagcacttgagatatcttagtccttactttacactctctttcagctctgaaacatcacacatctaagattcaagagtttgccgacctaactcaggttgaaacttttggctttcggggggaagctctgagctcactttgtgcactgaggtgatacaatatttttatccactcacttgaccccttagagaaacctctctgaaaattaattggaatcattattattttcagttttctatctcaacatctcaacttctagcttctgaattctgttttgtctcgctgccaatctaagtcatagtacttctgaaatgtgagcaataaatgaatgaaatgaagcaaatagtattgttaaaaagatggttacccttattaaaacagtaattctcaattttaacctaacatgtagataataaatgatagttaccattggttttcattatcaatttttagggaaacatttcaccaaagcactatttaattatagcacagatatgaaatttttataaataattatatatatatatatatatctttttttttttttagacagagtctctctttgtcacccaggctggagtgcagtggcacagtctcggctcactgcaatctctgccttccaggttcaagtgattctcgtgcctgagcctcctgaggagctggtactataggcatgcaccaccactcctggctaatttttgtatttttagtagagatgggatttcaccatgttgcctaggctggtctcaaactcctggcctcaagtgatctgcctgccttggcctcccaaagtgctgggataacaggcatgagccaccacgctctgccctacatatacattttaattataatatttgttagattctttaaaaaaaatttgttcgaagagtaataacaaaacaaatctgtgtttgtgaataaataaatcttaagatcatttatggttttgcagttcaacctgaaaaacgaaatcaaagcttttatcaaagcaaagcatgtttagtgctctctgtctcactgtcttttagatgccaaaccttagattttatgatgactcctcaaccatttagatcttgattatctcagagggatcgtcagctttttaagaaaattttgagagaaaagcaagtgaagaaaagagtagtcagtgcccaacatcatgggtctctcactgaacacaccatgcctggtattctctcacagcgatgtcaccatttctacctgccacgcatcggcgaaggttggaactcgactgatgtttgatcacaatgggaaaattatccagaaaaccccctacccccgccccagagggaccacagtcagcgtgcagcagttattttccacactacctgtgcgccataaggaatttcaaaggaatattaagaaggtacagtaaattaatcctggttttcaagagtattggttaatgcacatgagcaaaagatttactaaagatgtttattcttcagttgattctcttcccataaattattgagaaatgctttatttgcatttctcattaaagatttaacattaaagacttaactttaggatgatttacttttttcttttcatcacatagtgtttattaggactgggcaacacagtgagaccctgtctctatgaaaaattttaaaaaaaaatttactgggcatggtgacatgtacctgtagttccagctacttgggaggctgaagtgggaggatcacttgagcccaggaacttgaggctgcagtgagctatgattgcgccactgcacttaagactgggagacagaataagatcctgtctggaaaaatatatatacatatatatatattttttattttttatttttatctttttttgagatggagtttctctttggcgccctggctggagtgcggtggcgcgatcttggttcactgcaacctccacctcctgagttcaagcgattctcctgcctcagccttctgagtagctgcaattacaggcgtgtaccaccacagctggctaatttttgtatttttagtagagacggggtttcaccatgttgtccaggctggccaggctggtctcgaattcctgacctcaggtgatctgcccaccttggcctctcaaagtgctgggattacaggcctgagccaccatgcctggccttatgtacttatattttaataagaatatttctcggccaggcacagtggctcacacctgtaatcccagcactttgggaggctgaggcgggtggatcacgaggtcaagagatcaaagccatcctggccaaactggtgaaaccccatctctactaaaaatacaaaaattagctgggcatggtggcatgtgcctgtagtcccagctccttgggaggctgaggcaggagaatcgctggaatccgggaggcagaggttgcggtgagccgagatcaagctattgcactccagcctgggcacagagccagaccccatctcaaaaaaaaaaaaaaaagaatatttctcttggttttctgagaaatgagctattagaacccttatgaatttgaatgcaaatgaaaatagctaaatgttatatagtcgttgtgtttaaaaagcagattatagaactgtctgtattatttgattacaattttgtgaaaacaaaacaacaagcctaaatgtgtatagtataaaggctggaagactcggcactttcatgttctcagcagttatccttggatgtgagatctcatgcagtttttgctgtcttctttgtgccttcccattttgtatgtgtgtttttcataatctaaaaagttacttaaacatatgcagctaaaaactttttttacttgtaaagcatttggtgctaattttaactttctttttttttagatggagtcttctcactctgtcgcccaggctggagtgcagtggtgcgatctcggctcactgcaacctccacctcctgggttcaagtgattctcctgcctcagcctctcgagtagctgggattataggtgtgcgccaccacgcccagctaatttttgtatttttagtagagatggagtttcaccatgttggctagcctggtcttgcacccctgacctcaagtgatccacctgcctcagcctcccaaagtgctgggattacaggtgtgagccactgcacttggctgctaattttaactttattacattttttcacaaatttaaattttctaaagtagagaaaacttactctttttttgtatcttatggtaaaaaaattagtgccttagcagaatacaggaatgtagaacttctatttgtcagagataactgttatttacagtttgtatatcttttcaggctgcttttaatttcatgtgtttataactgttggaataattttcaagataaattcataagttaatataatgaaagcaagtaatatagaatgtacaacatgcaagtaatacagaattgtatgtggttgaaagttgtattttttttttttttttttttttaattgagacagggtcttgctctctcacctaggctgggatgtagtggcacaatctcagcttaccgcagccatgatctcccaggctcaatgaatcttcccacttcagcctcccaagtagctgggactccaggcccgtgctaccatgcccggctaatttttgttttttttgtagagatgggtccttctgtgttgcccaggcaggtctcgaactcgtgggctcaagtgatcctcccgcctcagcctcccaaagtgctgggattacaggtgtgaaccatcatgcctggccctataactgactttttacttagcatattgtgattgtcttttttagtcggtgcacactgccttatttgttgtcattctgctgcgctatggctataccataattaatcaactcctcaatgatgcttgcttaggttgtttctgtttgttcatagagattgtttcagtgaacatttttgtgtatctctttgcataccaaaatgcttgtgccagtgtttctattatacgaagatacatttcaaaaggagagattataaaatcaaacacaatgtacgtttcagttttttaattttcatttttagagatagggcctcactctgtcaccgaggctggagtgcagtggtgcaatcatggctcactgcagccttgaactcctaggctcaagcgatcctcccacctcagcctcctcagtagctgtgactacaggcacatgccatgacgcccggctaattttttttttaaattttttgtagagacagggtcttgctgtgttgcccaggctggtcttgaactcctggtctcaagtgatcctcctgccctcagcctcctgagtagctgggattacaggctgtactttttagttgttttaccaggatgcatggcacattgggaagtgagaggactgtgaccaggagccaaaagctctgcgttcctttctgtagaatataggaagacacctctttacagatcattctgtcaacagtgcttcccttgatttgtgcgatgatgtgagaaccttgcgttggatgttgtaacttgagctgtgtaattcctataatattaaagtaatgtagaatattgtgtttgtgttttttaaacaggagtatgccaaaatggtccaggtcttacatgcatactgtatcatttcagcaggcatccgtgtaagttgcaccaatcagcttggacaaggaaaacgacagcctgtggtatgcacaggtggaagccccagcataaaggaaaatatcggctctgtgtttgggcagaagcaggtagtgatggccggttacttcaacgcctcttattgctctagtgattatagcgggtttccattgtcccttccagtagaatggagaataaaatcttagaattgattttttttttttttttgagagggagtctcgcactgctgcccaggctggagtgcagtggtgttgtcttggctcactgcaacctccgcctcccagattcaagcaattctcctgcctcagcctcccgagtagtgggattacaagcatgctccactacgccaggctaattttttgtatctttagtagagacggggtttcaccgtgttggccaggctggtctcgaattcctgacctcgtgatccaccagcctcggcctcccaaagtgctgggattacaggtgtgagccaccaagcccggccggttttttttttttttgagctggagtcttgctctgttgcccaggttggagtgcagtggcgccatcttggctcactgcaacctctgcctcccgcgttgaagcaattctcctaccttagcctcctgagtagctgggattacaggcacatgccaccaggcccagctaattttttgtatttttagtagagatggggtttcatcttgttggccagactggcctcgaactcctgacctctagtgatccgcctgcctcggcctcccaaagtgctgggattacagacgtgagccactgcgcccagattaagaattgatttttaaagtgcctatcacaaggcccggcgcagtggctcacgtctgtaatcccagcactttgggaggctgaggtgggcggatcacgaggtcaggagtttgagaccagcctgatcaatatggtgaaaccccatctctactaaaaatacaaaaattatctgttcgtggtggcaggcacctgtaatcccagctactcaggaggctgaggcaggagagtcgctggaacccgggagatggaggttgcagtgagctgagattgcaccactgcactgcagcctgggcgagagagcaagacaccatcccaggaaaaaaaaaaaaaaaaaaacaaagtacctatcacaaaaattgatgtttgagagctgaatgtgtttcattttattcttccagagacactcgtatactgcgtcttttcactctctctctgaaaaaaatataagttattgtgggcaatgtgtgggttctgaataagtaggtacttgtttcatctttcttatatcataaaatcaaaattgttgttcccacggctcacacatgtaatcccagcactctgggagaggaaactgttgggattatgtgtttgaaccacccggccaacaattttgaggtgggagaatcgcttgagcccaggaatttaagaccagcttggataacacggcaagatcccatctctacaaaaaaattaaaaaattagccaggtgtggtggtgtgcacctgtagtcccagctactcactcgacaggctgacgcaggaggattgcttgaacccacgagtttgacattgcagtgaggtatgattgagccattgtactccagcctgggcaatagagggagaccctgtctcaaaaaacaaaacaaaacaaaagattcttttaattttttttgcgcttgtaatgtcaatagcttgactaagaaagaaaacagattaagtccactctgtctttattaggaagtaactgtgaatttttttttttttttttcagttgcaaagcctcattccttttgttcagctgccccctagtgactccgtgtgtgaagagtacggtttgagctgttccgatgctctgcataatcttttttagtaagtagattgctggcaagagaactacaattgaacattttatcctgagagctttttttttaaagatagtgattctaaggctaatagtttcgtgtctttttttttttttcttgagacggagtcttgctttgttgcccaggctggagtgcaatggtgctatcttggctcactgcaacctctacctcctgagttcaagcaattctcctgcctcagcctcctgagtagctgggattacaggcacgtgccaccacacccggctaattttgtatttttagtagagacggggtttcaccatgttggccaggctggtctcgaactcctgacctcagatgatccgcccaccttggtgtcccaaagtgctgggattacaggcatgagccaccacgcctggctagggataatagttttttatgtcctttataaaactgtgagcaatgctgtggctaagaaagatgatttatacaaaggagtcagttgcttaattcaaaccatgttttgagtaagtggtatatttcaggtggttttctgttgagcaggtcttctttaaggctctgtttagttagactaacttgtaaattattttatcattttaaatgattttgactttcctggcatctgatgaaggcagttcagtgtcattacttttcgtataagaaaatagacacttccataaataggattggtcctgtaaagatatctatctatctgtgtgtatatatatatatatatatatattttttttttttttagctttgagatggagtcttgctttgttgcctaggctgcagtgcagtgccgtgatcttggctcactgcaacctctgcctccctgcaacctctgcctcccaggttcaagcgatactcctgcctcagccttccgagaagctgggactacaggtgttcaccaccatgcccggctgattttttgtatttttagtggagacggggtttcgccatgttgcccaggctggtcttgaactcctgacctcaggtgatccacccaccttggcctctcaaggctctggaattacaggcatgagccaccacacccagcctaagatctgtatttctttttgtttgtttgtttgttgccttgagatctatatttcttactcttcctccacttgcttttggcttatgcctgaaatggtaaacatggagctttatgtctttatgtgaaggtggtgttcttctggaaatgccggtatccctggggtgggtctcatgtgaagcaagcgctttaccaagacatgagatataagcgtcctacccgggaggttttgaaaggggagggaatgtgggcaaaattctgagcacaagtggttagacttcattgacaaaccaggggtggcagcacggaggttctgagaatgcatttgaagcgagacccacttacagaggctgaggatttatcaggaagggtaaggagagctgcaacacatcagttttggacgcactgcatcacctgtggtgcattggttgactgtaggagctttagaatattccagaaggtttggttctttgatgactcatcaagatttggagcacagatacccgtgaactgcaatagtgatccttatcagcatgtcacctggtgttttgttttcatttcactttaagaatgtgccatgtgatcgtatttctaatccctttcactctggaatcctgcccttaccatattaatgttgaatagcatctcaggtttcatttcacaatgcacgcatggagttggaaggagttcaacagacagacagtttttctttatcaaccggcggccttgtgacccagcaaaggtatttaaaatttttttgtgttagtttgttctttatgcctttgacttttaattgataacttttttctgataataggcagtttacgtggagctcgggactttgagaaacatggctttaacattatcttattttgtgcatttacagaagtctaccgcagatggcccccagcttcagatgtttcaactgaagacttttctgtccgggcgcagtggctcatgcctgtaatcccagcactttgggaggccgaggcgggtggattgcctgaggccaggagttcgagaccagcctggccaacatgacaaaaccccgtctctactaaaatacaaaaaataaccaggcatggtgttccacgcctgtaatcccagctacatgggaggctgaggcaggaggatcacttgaacctgggagatggagcttgcagtaagccgagattatgccactgcactccagcctgggtgacagagcgagactgtgtttcaaaaaaatatatatatatttttttctactactttaccttgttgcagaagttattttttgcagtagataccatacttcaagtacctattgaaccattgtttttcggtatagtattcaataaattacagaagatattcaacattttattataaaataggttattttgcctatagactatgtaagtattctgaggcaaggctgagatgggacattcagtaggttaggttatcacaaaggcatttttgacatacagtattttcttttctttctttttttttttctgagacggagtcttgtttgtcacccaggctggagtgcagtggcgtggtctcggctcactgcaagctccgcctcccaggttcacgccattctcctgcctcagcctcccgagtagctgggactacaggtgcctgccaccacgcctggttaatttttttttgtatttttagtagagacggggtttcaccttgttagccaggatggttttgatctcctgacctcgtgatccgcccacctcggcctcccaaagtgctggaattacaggtgtgagccaccgcgcccagcagatacaatatttttaacttatgggtttatcaggacataaccctatcataagttaaggagcgcatctatctgtgtacagttttttttgttgttgttttttgggtttttttttgagatggagtctcgccctgttggccagtctggagtgcaatggtgcgattttggctcactgcaacctccacctcccgagttcaagcgattctcctgcctcagcctcccaagtagctgggattacaggcgcgcgccaccacgcccggctaagtttttgtgtctttagtagagacggaatttcaccatgtggccaggatggtcttgaaatcctgacctcgtgatctgcctgccttggcctcccgaagtgctgggattacaggcgtgaaccaccgcgcctggcctctgtatagttttttaaattgcatatacgtgagtgtgtttgtatctgcatatatacattatatgtgttgtgtgtatagatacataaatatataaacacatattaccagtatatttattattgtaaaaactaaaactatttgaagaaactaaacattttataacattctatgtcacctttcagtatagactgattacatggtttctatatttcctttttttttttttttttttttttttgagacagagtctcgctctgtcacccccaggctggagtgcagtggcatgatctctgctcactgcaagcaccgcctcccaggttcacgccattctcctgccccagcctctctagtagctaggactacaggcacgcatcaccacacccggctaatttttgtatttttagtagatacggggtttcaccacattggccaggctggtctcgaactcctgacctcgtgatccacccgcctctgtctcccaaagtgctgggattacaggcatgagccaccgcgcccggcccatggtttctatattttctatagatttctatattttctcttctttctattttcctaggaaaataagggctcagattacttctgcctcagatttaaattgatcatcttgatatgatgacatgggttttttgagtttgtatcttagcaacacattgtacctcagtaatattttgtttttttttctttctttcttttttttttttttttttttgagacggagtctagctctgtcgcccaggctagagtgcagtgacgtgatcttggctcactgcaagctctccctcccaggttcaagcaattctcctgcctcagcctctcaagtagctgggattataggcacatgctgccatgcctggctaattttttgtatttgagtagagatggggtttcactgtgttgcccaggctagtcaagaactcctgagctcaggcaatccacctgccttgacctcccaaagtgctgggattacaggcgtgagccaccgctcccagcccctgtttttcaatgatgctttagagtttgcttgtaatctgccagatgtggttgaacttctaaattttttaacctatagtgtgatggattcataattattaattataactattaataatgtgatattttggtttatttctaatgacattttaatgtcatagatacttttctatgtacattgaatatgttttatgaacatttaagctgcacttgcatttcactagaatttctcatagagcaactttaagttggaaaaatattcagttttaggaatctatgattagagaaatatcactttgagattgtgaggaaacttttggtgatggatatattcattatcttgattgtggggatagtttcacaggtgtttgtgtatatgtcaaaacttatgaaattgcacactttaaatatgtgtagtttattccatgttagtcatatctcagtaaagctgttaaaaaaatgtatccttaggccaggtgtagtggcttacgcctataatcccagcactttgggaggttgaggcgggcggatcaactgaggtcaggagttcgagaccagcctggccaacatggtgaaaccccatctctactaaaaacacaaaaattatctggtcatggtggcgtgtgcctgtaatcccagctactctggaggctgagtcaggataatcacttgagccccggaggcagaggttgcagtgagccaagatcgtgccattacactccagtctgggtaacaagagcgagactccgttgaaaaaaaaaaagaaaaaaaaatcctgcctgtaatccaagttacatgtcaggctgacacaggaggatcacttgagcctgggaggttgaggctgcagtgagccatgattgctccactgcactccaggctgtgacaaggcgagaccttgactcaaaaaaaaaaaaaacaaaaaagtatccccttctaagaacatgctggttggttagaatagaatgttgttagaatgcggggggctgggaacatttgtcatttattcttttctactccttgtattttgtgcaggtctgcagactcgtgaatgaggtctaccacatgtataatcgacaccagtatccatttgttgttcttaacatttctgttgattcaggtaagttccattggcatttcagtacaactagtgactaatgcctcaaagaataaaatgaaattctacagctctgctatgactggaatgagataacaatttatggtcatgtaagttttttgtttttgtttttttttgagacggggtcttgctctgtcacccaggctggagtgtggtggcgtgatctcggctcactgcaacctctgcctcccgggttcaagcgattctcctgactcagcctcccaagtagctgggactacaggtgcgtgccaccacacctggctaattttttgtatttttagtagagacagggtttcaccgtgttagccaggatggtctcgatctcctgacctcgtgatctgcccgtcttggcctcccaaagtgctgggattacaggcatgagccaccgtgcctggccctataattttttttttttttaaacagagttcccgctttctacttgagactatgttaattatattgttaggaaaatgtaattttttttaatgtcaaccaagggagaaagtagatgaaatgttcttcctaatttcataaataattcatttcatatagatttttttttctgattgttaaaattttggtttattgtaattgagtattttttctagatacttagaaacacatatgtacataccttaaaaaatatcttctgtcctctctctctttctctctctctcccctactcccatattctttgggatgagaaaataattttgtatactgctctttatccttagatgtgaatgttttcttttccatgttattagaaattgatcagaaatgtggttttaataggtgaattatattccaatgcatggttatagtttggtattttaatttttaaatttttcaaaattaaattgtttttagtttttggaaattataaatactttccttataattaaatcattatctgcatctttattattagatattttttgagacagagtcttgctctgtctcccaagctggagtgcagtggtgtaatatcagctcactgtaacctccgattcctgagttcaagcgattctcccgcctcagcctcctgagtagcacggattacaggcacctgccaccatgcctgactaattttttgtgtttttagtagagacggggtttcgccatgttggccaggctggtcttgaactcctgaccttaacttatctgttcgtctcagcctcccaaagtgctgggattacagggtgtgagccactgcactcagcctacatctttaattattctgaatataaattgccgggagtagaattactgggtcagtgaatatgatcattttaaggctttttctgtattgtgttctagatgtaccaatttacacacctacctataatgtactaggtattataattgttaagctaaattcagtaggggattaaaatatcttattttagtttgcatatttaaaattatttttatgtgtttatttgcttttcctttaacaatttacctaattaagcccttccgtattttgtctattcaaaaattgtcttttgctcatttatttgaaaaagctgatttcataacttatgaatcttaacctggacactgtaatgtttttaatagcacttgtgataaatacaagtgaatgaaataatagatggggaaatttctattgttaaaagtgaatttggctgggcgcggtggctcacgcctgtaatcccagaactttgggaggccaaggcgggtggatcacttgaggttgtgagttcgagaccagcctggccaacacggtgaaaccccatctctactaaaaatacaaaaattagccagtgtggtggcacttgcctgtaatcctagctacttcggaggctgaggcagggagaatcacttgaacccaggaggcggaggttgcagtgagctgagatcgcgccactgcactccagcctaggcgacagagtgagacgctgtctgaaaataataattaataaataaaataaaagtgaatttaaacataataaatatgttttcttttttgccttagaatgcgttgatatcaatgttactccagataaaaggcaaattttgctacaagaggaaaagcttttgttggcagttttaaagacctctttgataggaatgtttgatagtgatgtcaacaagctaaatgtcagtcagcagccactgctggatgttgaaggtaagaaaaatacagtgtacaaacagcttctaaagcttttagctaatgtgtttccttattttttccaagtaaacttttttttgacatgaaaacaaagtctcttatattattttatcatttttaattcttttttgagacagggacttgctctgtcacccaggctggactgcagtggtgccattgtagctcactgcagcatcacactcctgggctcaggccatcttcctgcctcagcctcccaagtagctgcctccaagtacctctagttttttgtaaactgtaaacggatgaagtcatataagatatatgattagaagaagtctgcagtgactgcatttttaactcccttgtcatgtctgtttttttgagatggagtttcgctcttgtcacccaggctggagtgcaatgatgcgatctcagctcactgcaaccttgaagcctcccacgttcaagagattctcctgcctcagcctcctgagtagctgggattacaggcgcccaccaccacacctggctaatgtttgtattgtcattagagatggggtttctccatgatgcccaggctggtctcaaactcttgagctcaagcagtcctctagccttggcctctgaaaatgctgggatttcctgacttctaacagtagaatttaggccaggcgcagcggctcatgcttgtaatcccagtactttgggaggccaaggcgggcggctcacgaggtcaggagatcgagactatctaacacggtgaaactctgtctctactaaaaatacaaaaaattagccgggcgtggtggcgggcgcctgtagtcccagctactcaggaggctgactcaggagaatggcgtgaacccgggaggaggggcttgcagtgagccaagattgtgccactgcactccagcctgggtgacaaagcgagactccgtctcaaaaaaacagacaaacaaacaaaaaaaacccaaaacggtatagtttaatctgtttttaatttgaagttattcagtctgtccttttctgtgatttgtttctttctctcattattttgtttgtgagattcacccaagtcatgtggcaaaattcatttattcgttcgctatacagtgttccattatagtcagatatcatcatttgtgaatatttgaattgtttccagtttggggctataatgaagaatgctgtcatgaacatcctcatccacgtctttttgacgagcatagataggcacttctttcttttttttgagagggagtctcactctgtcgcccaggctggagtgcagtggagtgatcttggctcgctgcaaccctgccttccaggttcaagtgattctcctgcctcattctcattctccctagtagctgggattataagtgcattccactatgccctgctaattttttttttgtatttttagtagagatgaggtttcaccatgttggtcaggctggtcttgaactcctgacctcaaagggctaggattacaggcgtgagccactgtgccggccaataggcacttctgataggagtagctatgctgggttgcaggtgtgcatacattcagatttaggaggtattcccagagaacttttcaaagcagctgtaccaggttcattcctaccagaggtattcaggcattcctcttgatcctgatctttgtgagcatttgttgtttttttaattttaccattctggtgagtatatggccatattgcattgtgttgtggttttttttttttttttttttttttttgagacagagtgttgctctgtcacccaggctggagagcagtggtggcatcttggctcactgcaacctctgcctcccgggctaaagggattctcgtgcctcagcctcccaagtagctgggatgacagatatgccaccacacccggctaatttttgtatttttagtagaaacagggttttaccatgttgtccagaccagtcctgaactcctagcctcatgtgatccccctgccttggcctcctaaagtgctgggataacaggcgtaagccaccacacctggcccatattatagttttattttgaacattgaactgtgttcatctgtgtaattagcatgtggatctcctcttttgtgaagtatctgttcacataagcacgtcctctcaccatttcaggatagtccctgaccctcttctccgtccacgtttgcttaggtaacttaataaaaatgcatgcagcggatttggaaaagcccatggtagaaaagcaggatcaatccccttcattaaggactggagaagaaaaaaaagacgtgtccatttccagactgcgagaggccttttctcttcgtcacacaacagagaacaagcctcacagcccaaagactccagaaccaagaaggagccctctaggacagaaaaggggtatgctgtcttctagcacttcaggtgccatctctgacaaaggcgtcctgagacctcagaaagaggcagtgagttccagtcacggacccagtgaccctacggacagagcggaggtggagaaggactcggggcacggcagcacttccgtggattctgaggggttcagcatcccagacacgggcagtcactgcagcagcgagtatgcggccagctccccaggggacaggggctcgcaggaacatgtggactctcaggagaaagcgcctgaaactgacgactctttttcagatgtggactgccattcaaaccaggaagataccggatgtaaatttcgagttttgcctcagccaactaatctcgcaaccccaaacacaaagcgttttaaaaaagaagaaattctttccagttctgacatttgtcaaaagttagtaaatactcaggacatgtcagcctctcaggttgatgtagctgtgaaaattaataagaaagttgtgcccctggacttttctatgagttctttagctaaacgaataaagcagttacatcatgaagcacagcaaagtgaaggggaacagaattacaggaagtttagggcaaagatttgtcctggagaaaatcaagcagccgaagatgaactaagaaaagagataaggtaaagttttaattttttactttttctctttttatctaaaatttttatttttattttttatttttttgagacagagtcttgctctgttgcgcaggctggaatgcagtggcatgatcttggctcactgcagcctccacctcccgggttcaagcgtttctcctgcctcagcctcctgagtagctgggattacaggtgcacgccaccatgcctggctaatttttatatttttggtggaaacagggtttcaccatgttggctgggctggtctcgaactcctgacttcaggtgatccagccaccttggcctcccaaagtgctgggattacaggtgtgagccaccacacccggccaggtaaagttttttcttaagagtattttgaggctaggtgtggtggctcacacctgtaatcccagtactttgggaggccaagccaaggagggaggatcacttgagcccaggagttcaagaccagcctggacaacatagggagacctcgtctctacaataaaattggctgggcgcggtagtgcgcagttgtaattccggcatctgcgcctggccagatcctgttctctgtggcaggacacagactccaaacacatggaagacttgggtcttttaggccagcaccagcttttgagcagattatctatgtactgggaaccagggcatattcagacaattcctgggagagcctgggatcggcgccaggggaggtggtatttgtgctggcatctgggatgcttctgggatgttcttttccttccctcctgtgcggcaggagttcctgtgtcatcactcactctggcagcttctctccatccagcaggctgcggccactcctgctccaaggaggtctgaaactcagcctgagtgggtaggagcctcttacaagagttccttttctgctgggcatggtggctcatgcctgtaatcccagcactttgggaggctgaggtgggtggatcacctgaggttgggagttcgagaccaggctgaccaacatggagaaaccttttctctactaaaaatgcaaaattagtgggatatggtggtgcatgcctgtaatcccagctacttgggaggctgaggcaggagaattgcttgaacccgggaggtggaggttgtggtgagccgagattgcaccattgcactccagcctgggcaacaagagcgaactccatctcaaaaaaaaaaaaaagaaaaagaaaaaagaaaaaaagagttccttttctgaggactctccctcttccctaggatagtagcattttccattcctgtatttcttagcatagtagttaaccaccttttactagtttgtgtaatgccttattatacatttttcctcctcaggcctaacatggtggtgcacaccttgtaattccagcactttgggaggctgaggcaggagaatcacttgaggctaggagtttgagaccagcctgggcaatataatgaggccccatctctaaaaaaaaaaaaaaaaaaaaaaaattagctaagtacattgctgtacgcctgtagtcccaggtactcagggggctgaggcaggaggctcacttgagcccaggagtttgaggctgcagtgagctatgatcatgccattgcactccagcctgggtgacagagcaagaccctgtcttaaaaaaaaaagtccctgttaaaatcactggtgtggtttttgtctcttgattgattgcactctgcctgatctggaattggtaccaggaaacagaccctcaaagataggatttggggactggtttggttatgacttggatttgagctctgtgtggagcccctcaccataggaaatgtgggctcagtaatccatgccatgtggaggtctcacagttcaccaaactgtcccctgtggttgattgtgatggtgacgagcatggtggcatgggaccgggtcttcctggagcacttatagaaagaaacaacaatatcagctcctttgttttttttttgagacaagagtctcactctttcgcccaggctggagtgcactggcacgatctcagctcactgcaagctctgcctcccgggttcaaacgattcttctgccttcgtttcccaagtagctgggagtacaggtgtccaccaccatgcctggctaatttttttatttttagtagagatggggtttcaccatgttggccaggctggtcttgaactcccaacctcaaatgatctgcccaccttgtcttcccaaagtgctgggattacattacagctgctttcatcctcagctcaggccaccaggtgagaaccagaaaacgtccatggctgctttaacagagccatttcttgtcatcaccgcgctgatactgcggaaaatccattttcaccggatttaattgtgtgggactgagaatgacagtgtcaatttctcgtgtgaaggttagcggtggtgtctgtcttttgtccagattgactaagttagtatttaatgacattagatgttgaagccacccgcaaaggacccagtggtgggcctggcaaagatgagaaggattgatatccagcattggcagaaaggtgctcttacacaccattggtgggagtgtgacttttcacagatttcccgtcaagaagtacatatgtagttctccctctagcgtctgtctcacggaaatgcacccacagatgagtaggtttatgcacagaagtatttgttgcagctttgagtgcgctattgaaattggaaacaactgaaatgtcctttagtaggggatttgtcagacaaattatggtacatccatgcaatgaattcctatgtggccattaaaaagaatgaagtaggccaggtgcggtggctcacgcctgtaatcccagcactttgggaggccgaggcaggtggatcacttgaggtcgggagttcaagaccagcctagccaacatggtgaaaccttgtctctactaaaaataaaaaaattagccgggcttggcggtgcatgcctgtagtcccagctactcgggaggctgaggcaggagaatcgctcgaacctgggaggcgcaggttgcagtgagccacggtcacgccactgcagtccagcctgggcaacagagagtgagactccgtcttaaaagaaaaaaaaaaagaaaaaataatgaagtagatctatgtgtacaggtctgaaaacttgtttcagatgcattaagtgatgacagaatggagaattaagattccatttttgttttttaaaattaaaaaaaattatatatggagacaagggtctagaaggatatattccatttaaatcgttaatagtagcaactgatgtcttctccggagagttggatgaatgaataattaatgttatctttagaaagtgggatggttaagccgaacgcagtggctcacgcctgtaatcccagcactttgggaggccaaggcgggcagatcatgaggtcaggagttcgagaccagcctgaccaacatggtggaactctgtctctactaaaaatacaaaaattagctgggcatggtggcgcacctgtaatcccagctactcaggaggctgaggcagaagaatcactcgaacccgggaggtggaggttgcagtgagccaagattgtgccattgcactgtagcctgggtgacagaacgagactctgtttcaaaaaaaaagaaagcgggatggctagggactttattttgtttttgtattgtttgactttttttttattacagtgttctataacataatcagaaaaataatcttgtaaaatgtctgataattaacattttctacctgcagtaaaacgatgtttgcagaaatggaaatcattggtcagtttaacctgggatttataataaccaaactgaatgaggatatcttcatagtggaccagcatgccacggacgagaagtataacttcgagatgctgcagcagcacaccgtgctccaggggcagaggctcatagcgtgagtgtgtttagtgttcattcccagactccccctcaaattgaagatctaatagaggccaaggcaggaggatcacaagaggccaggagtttgagaccagcccggacaacacagcaagaccttgtatctactttaaaaaagaagagatctaggaaggaggggtgtaaaaaataaaaaatatctagttggccaggcgcggtgcctcacacctgtaatcccagcactttgggaggccgaggcaggcagatcacctgaggtcaggagttggagaccagcctggccaacgtggtgaaaccccgcctctactaaaaatacaaaaaggccaggcacggtggctcacgcctataatcccggcactttgggaggccgaggtgggcagatcacttcaggtcgggagttcgagaccagcctgaccaacatggtgagacctgtctctactaaaaatacaaaattagccaggcgtggtggcgggcgcctgtagtcccagctacttgggaggctgaggcaggagaatcgcttgaacccgggaggcggagtttgcagcgagccgagttcgtgccatcgcactccagcctgggcaacaagagtgaaactccgtctcaaaaaataataataatgataaaaaataaaaatacaaaaaattagctgggcatggcagtgcacgcctgtaattccagctactcaggagactgaggtaggagaatcgcttgaacctgggagacagaggttgcagtgagccgagatcgcaccactgcactccagcctgggtgacagagcgagattctatctcaaaaaaaaaaagagacctaatagtttatatgtgtgtctatatgtatatatgtatttttccataagtattcatatagcagatttttatactttttacataatagtgatagttaccatttattcagtgcctagaatctgccaggcactgttgaaataatgtatgtgtattagttcctttaatcctcaaaaacctatggggttgttactgttaccatcaccattccacaagcgataaaactgaggcacatgcagagaggttgagtaacctgccccagttcacgtggttaacatgttctctaagtatcaggtatttttcgctattaaaaatgttgatcactggttagccagaagatccttctgatgagggcaattgatagtatggagtattagtatgcatagtgtatggaatgtgtgtgttcagaaagacagacagcctgtgcgccagtgttgattgacagtagagtaatcagaagtcagatagtcactgcaggttggatgcaggggcacacgcctgtaatcccagagctttgggaggctgaggcaggcagatccctcgagcttaggagtttgagaccagcctgggcatcatggtgaaaccttgtctctacaacaaatgtaaaaaattagtcagacttgatggtgtgtgcctgtggtcccagctattcgggaggctgaggtgggaggatcgtttgagcccaggagattgaggctgccatgatcgtgccactgcacagctctccagcctgggtgacagagtgagacagtgagactctgtctcacaaataaattaataaataaaataaaataaaatttaaaaattattttaagatagtcactgcagaatttggtatttctctctcctcggccaaactggaatgttttaccctgactacttcacaaaggtcaggtgtgatagtatcatgtaaaaccaaagtcttgtcttcagcaaagttagaagaagaggtcatggattttcgtgtgggaaattaaaccacgtagtgaagtaaactcagatcccaacaagtagatcccacatggagaaatgtaccactgaacctgtgtagtttgctgagtactctcctgtgtagtttactgagtactctcctgtgtagtttgctgagtactctcctgtgtagtttgctgagtactctcctgtggaatgcgtgaattgtttttattctcagtaggaggcaatggtaataatagacatttagtaagctactttatatcccttccctgttcctcttaatagaggttttttgtttttgtgtttttgagacagagtttcactctttcgcccatactggagtgcagtgatgtgatctcggcttactgcaacctctgcctctcgggttcaagtgattctcctgcctcagcctcccgagtagctgggattacaggcacccgccaccacacctggctaatttttggatttttaatagatagggagttttgccatgtttgtcaggctggtcttgaactcctgacctcaggtgatccaccaacctcagcctcccaaagtgctgggattacaggtgtgagccaccatgcccggctgaggtcttgtattttttagccattcggcaaagataacctctcatctgtgacatttcaagttggcccaggtaatcacagaccacttagggtcccagatggaccacacttcaagattaaaggataaagacccagttccaccctgccctgccagcccctgtgtagggtggccctgttgacctctgtagcttttcccgttcgtcttccccttgttccctgtactcaagcctctctggctgtctttctttttcccttggcaggcctgatgaatccctatgtggccactaagcagaatgaaggatatctttatgtgtggctctgcaaacatcagcggtccatcctggggcttggcacagattgttgtccctgtctagaatacttgtcctgcaccctgcacccacttctcccccgttacctgattaactctcttatccccggactcagctcaaaggtcacttcctgaccccagggtgaagtctctctatgacactggctgctttttcttcctgaccttcctgtcgtttctcatcataatcgacttgcctgagtatttgctcaacgtctttcttccccggtaatctgttggctccaggaccaagcctgtgtttgctcaccagctgtctcctgccttgagcagtgtttgtcttatccagcactcaggaccagatgcagtggctcacactcgtaatcccagcactttgggaggctgaagtggaaggatcgcttgagcccaggagtttgagagcagcctgggcaacatagtgagaccctgtctctatctttgaaaaaaataacgaaaggttaaaaaaaaacaaacagtaaatccaggaggagagagggatggagatataatacaggcagaggaaggaacaggatagcaaaataaaagctgtctgttcattctgtttacaaatgctggcaatgacctaacccagtgtttcaaattctgtattagaaggaggaaaaatagcatttttgtgatactgttatccttaaggaaaggattcagaaaaagtgggagtcattggcgtggcaggctgaggaaaaagcaaactacttttgtagctacttgaactttttttttttttttgagacagagtcttgccctgttgcccaggctggagtgcagtggtgtgatcttggctcactgcaacctccacctcctgggttcaagcaattctagtgcctcagcctcccgagtagctgggattacaggcatgagccaccacttccagctaatttttgtttttatgggtgttttttttttttttttttttttgagacagagtcttgttgtgtcgcccaggctggagtacagtggcgtgatcttggctctcactacaacctctgcctccctcctgggttcaaacgaatctcatgcctaagcctcccaagtagctgggactacaggcgtgcgccaccatgcctggcctaatttttatatttttagtagagagagtgtttcgctgtgttgaccaggccggtctcaaactcctggcctcaagagatctgcctgcctcgggctcctaaagtgctgagattacaggcgtgagccaccgcacctggcctgtagctactttaacttctaaaaagaactttaagaaagagaaaattaaaaggaacttctcaggaagttttgtgacacttagctgagtagtgttgttatttgtgttgttattttgacatgaattcaaaatacagtattgttgttttcatttcatttctgctgtaaagctaaatgtttgacttcaggatatggtttgaatcatttttgtgtttttcagacctcagactctcaacttaactgctgttaatgaagctgttctgatagaaaatctggaaatatttagaaagaatggctttgattttgttatcgatgaaaatggtaagttattaattagaactatagcggctgggtgtggtggctcacgtctgtaatcccagcactctgggaggccaaggcgggcagatcgcctgaggtcaggagtttgagaccagcctggctaacatggtgaaaccccatctctactgaaaatacaaaaagtagccgggcgtggtggcgggtgcctgtaatcccagctactcaggaggctgaggtgggagaatcgcttgaacccgggaggtggaggttgcagtgagccgagatcacgtcactgcactccagcctgggcaacaagagtgaaactctgtctcaaaaaaaaaaaaaaatcagaactatagattcttgtctttttagagctgggaataatctttcaggtcatatagaccagttttttttaattttataaaagattaaaaagttcctccaaaaagcattttgtgagtttcctctctttcaggtgttcactttttttttttctgagatggagtcttgctctgtcgcccaggctggagcgcagtggtgccgatctcggctcactgcaagctccgcctcccaggttcacaccattctcctgcctcagcctcccgagtagctgggactacaggtgcctgccaccacacccagctaattttttctattttttagtagagacggggtttcaccatgttagccaggatggtctgtatctcctgacctcatgatccgctggcctcagcctcccaaagtgcagggattacaggcgtgagccaccacgcccggcctcagatgttcatcctaagtagctttcaagtgaaacgtgtttgtcaagtcatggatttttctcaaaattgtattcttttagctccagtcactgaaagggctaaactgatttccttgccaactagtaaaaactggaccttcggaccccaggacgtcgatgaactgatcttcatgctgagcgacagccctggggtcatgtgccggccttcccgagtcaagcagatgtttgcctccagagcctgccggaagtcggtaagtaaagaaagcctggctgtcagctcagctgctcaagcttgcagtcgaggaaggtctcagcccagctcctgatttggtcaaggttgtaaacgcctttgtgattgccaggggtcattttacacagagagctacgtgcagcgtcgtagctgagcatctgtgtcgtctgcgttctctgtgaccttgaactcataattattgctcttttgttacctctgttaagcagtattcttggccgggcatggtggctcaagcctctaatcccagcactttgggaagctgaggcgggcggatcacgagttcaggagatcgagaccatcctggctaacatggtgaaagcccgtctctactaaaaatacaaaaaaattagccgggcgtggtgtcgggcgcctatagtcccagctactcgggaggctgaggcaggagaatggcgtgaacccagaaggcggaacttgcagtgagccaagttcataccactgcactccaacctgggcgacagagcgagactccgtctcaaaaaaacaaaaaaaacccagaattcttcttttttttttttttagacagattctccctctgtcccccaggctggagtgcagtggcacaatcacagctcactgcagccttgacgtaccaggctgaagcgatcctcctctctctgtctcccaagtagttgtgaccacaggcatgcaccaccatgcccagctaatttttaaattttttgtagaaacatggtctccttttgccccttgtctcagcctcccaaagtgctggaattacaggcatgagccactgtgcctggcccggccagtattctatctccgagctttggttgactccaacgcagttagcgtttgaggtaccttgttcgtctatggaccttatgggtcataacaacattgggagataaagatttgctgctgccaggactcggcgacattggacacgattctgcagagtcatcgaggcagcaggtgcttcacggggtgccgtggttgtcattgcacgtggcgtcactgccgctgcttcggttggtgtgggaaggtggcagcagtggttctgcctgcagtggggattagcctgatgtccaagaaaagtgactgtgtatcagctggccactgggaagggccaggacgccattcctttatttattcagcaggtgctccttgagcccctgatgtggggcccgccctgctccaggtgctcgggacacagaggtaacaaggcggctgcagcccctgcccctgtggagcagacagtggggagaaataggcatcaccacaaataaatgacacgcattagatgccagtaagcacagtcaagagattcaaacagcatttttctttgtctgtttttgagacggagtctcgctctgttactaggctggagtgcagtgatgtgatctcagctcactgcaacctccgcctcccaggttcaagcgattctcctgcctcagcctcccaagtagctgggactacaggcacccaccacacctggctaatttttatatttttaatagagatggggtttcaccatgttggtcaggctggtgttgatctcctgacctcatgatctgcccgccttggtctcccaaagtgctgggattacaggcgtgagccaccgcacctggcctaaaacagcgttttggggcaggaaatgacaagagaaaaacatggtgaccaggtgagatggtggtcagggaatggcatctgggcaggtggcatctcagctgccatctaaaaggtgggatggaagccaggcatggtggctcacacgtgtaatcccagcattttgggaggccaaggcaggaggattgcttgaggccaggagttaagagaccagcctgggcaacacaggcagaccccatgtgtacaaaaaattaaaagattagccaggtgtggtggcatgtgcctgtagtcacagctactcaggaggctgaggtgggaggatcacttgagccagggaggtcgaggttacaatgagccaacatcacgcaactgcactccagcctgggtgacagagtaagaccttgtctcaaaaaaaaaaaaaaaaaaggtagaatggagccctcttgggtaagaactttccaagcgaaggaagtagcaagactgaagccagaggctgattgtgtccctggagaggggaagggagtgagcagagcggcgtccagaggacagccacgtagagtgttgccggtcatacctagaccctgggggtctgtgctgtgtgtggcacgagccactggagagaacagacgggaaggagtcccgtgattgcagctgctggagagagaacagactggaaggggtgcggtggctgcggccgctgaggagagcagcagctgggggccacgtggggagtgggtgggatggagcctgctgtgtgagcttcaggtgtaatttacagccatgagattagatgaaatgactcaagggcagagtttaattagaagagggcccagagtctgacttctagccacagtgtttcttggataaagacctaataggggctgggcgtggtggctcacacctgtaatcccagcactttggaaggcggaggtgggttgatcacctgaggtcaggaatttgagaccagcttggccaacatggtgaaaccccatccctactaaaagtacgaaaattagctgggcatggtggtgggcgcctgtaatcccagctactcgggaggctgaagcgggagaattgcttgaatctgggaggcggagttgcagtgagctgagatcgcaccattgcattccagcctgggagacagagtctctccaccacccctgacctcaccaaaataaaagacataatatggatcttccagtcttggagtctgtgagtgagagcgtggagctgagctcatagccgggcagttttgatgtcctgagtttagtgtgactcagtggcccggggaaccacaggctgctccttccctctcgccctggcctacccgtccatctccggtgttgtcactgcctgcccaggaggctcctgctttgagccctgcccacccttccagccccatctccccaccatgtagcttccagccatgtagctgccttccagttccacgctcgcctcagtctcctccctgccttacaccctttctccctactctcctctctacctgggtttgccaccgtcacccttcaccccatccccacacctgagcaggccgcctcgcctggtgccacctgtcttggttctctgttgacttgttgattgtctgtccttctccaacctgctgtcaccccagccttctgactgtgcttggcacatggcgagccctcagggtgctgcaggaagaaagaaggtgacattgggcttcaggcttgtgtcctctccttcctgtcagaggacccatggcagggaggcagcagggccagggctggagtgctatgggcagcaggtcggagctcgacagagggggagtgacgcctgcacccattgggggagagggtcccgggagtgccacagtcccaaggcaggtgtttgcgtgatgggcctgtgcaagaggaagggagtagcagtgcagctggggtgaggaagggaggcattcgtgcttggaggtgggggtgcaggcacagcccagcgagggccaagtcaggggacagacgggggcttttattcaggtgagggggagagctgtgaagtggaatgaataacctgacagccctttaaaagtaatcactggctgctgagtggagagcggctcggaggggtcgcagtggggcagggaggcctgctgggaggctgctgcacctgccagggtgagagggcagggtggctgctgagacaggtgtggtcggcgtctggagtggaggcggtgccaccttgaaggagccacaaggagcctgatttcacagaagggtggagggctgagatctagaacctaggcttctctgggggaaggtttttcagggaaggtagtttttgagctgtaatcttgtccagccttattttagagaagaatgcttctgaagagctgccattctgacgtcaaaaaactactaaaacgttgaaccattgtgtctcacactcaggtgatgattgggactgctcttaacacaagcgagatgaagaaactgatcacccacatgggggagatggaccacccctggaactgtccccatggaaggccaaccatgagacacatcgccaacctgggtgtcatttctcagaactgaccgtagtcactgtatggaataattggttttatcgcagatttttatgttttgaaagacagagtcttcactaaccttttttgttttaaaatgaacctgctacttaaaaaaaatacacatcacacccatttaaaagtgatcttgagaaccttttcaaaccagatggagcattgcttgcaaattttttttctctatgtttgcatgcgctcgtgtgtgtgtgtccaggcaagaacacattttataaaaataagaacacttgggctgggcatggtggctcatgcctgtgatcgcagcactttgggaggccgaggccggcggatcacctgagatcagaagttcgagaccagcctgaccaacatggagaaaccctgcctctactaaaaatacaaaattagccaggtgtgctggcgcatgcctgtaatccccgctacccaggaggctgaggcaggagaatcgcttgaacccgggagacggaggttgcagtgaaccgagattgcgccactgcgctccagcctgggtgagatagaacaagactgtgtctcaaaaaacaaaacaaaacaaaacaaaaaaaaaaaaaccaaaccactttggaagttactcaggcctctgctctggctggacatagtttagtctataactttcaacccttaatgataattaaattcatctttgtttaatttcataaatttaaaagtagggtccttttcagttagtgattctcagccctgattcacattaaatttttaaacacgggggattctctgcccggctggaagaaaatgactggatgggacaggggtcactatttgaaacattcctctgtgcggccaaggtcgcaaaatgctgtcctcgcaggggaacaaaaagagtttgatttcccataatttgatgctgtgatttggtttcctcaggatgtgaactgtagaacattccagttactggccttgaatggttctgggaatataagaatccctgtctgtcttttcaaatagttttcatggaaccttgtcctgtttgaacttggctgaaaatggaagtaaagatgccctcttgggggcccagagatgacagatgtggctccccctgctgcccccaccccttctccagactgtgggcggctccccttcctgctttagaatccctcagatggaggaggcagtacagtagtcactgtgccatcgtgtctggcactgtgctggcgtggtctgcaggatcccacttatgaactctccagattgggagctgtggcaggataacagcccccaagacagctgtgtcctaatccccagaacctgtgaccacgctgcctcacgtggcagaagggactcggcaggtgtgattgagtgaaggatcttttttttttttttctttgagatgaagtttcgctcttgttgcccaggctggagttcaatagcatgatctcagctcactgcagcctctgcctcccaggttcaagtgattctcccacctcagcctcccgagtagctgggattacaggtgtccagaaccatactggctaatttttgtatttttagtagagacagggtttcaccatgttgaccaggctggtctcgaactcctgacctcaggtgatccgaccgcctcggcctcccaaagtgctgggattacaggtgtgagccatcatgcctggctgagttaaggatcttgcaacagagagattatcctggattgtctgggtgggcccagtccattgggtgagtccttcaaaggtggagacctttccctgctggccagagagaggctgtcttgctggttttggagatggaaggaggtaccactagtcaaggattgcaagcagtctctagaacagggattccaacactccggacacagaccagtagtggtccatggcctattaggaagtggggtgcacagcaggttaggggccggcaagccagcgaagcttcatctgtatttatagccactccccgtcgctggcgttaccacccgagctccgcctcctgtcacatcagcggtgggcattagattctcatagcagcacgagccctattgtgaactgcacacacgagggatgtaggttgcacgctccttatgagaatctgatgcctgatgatctgtcactgtctcccgtcacccccagatggggctgtctagttgcaggaaaacaagctcagggctccc

SEQ ID NO: 41 - DNA, 30 bp, Artificial Sequence
  Description of Artificial Sequence: Synthetic oligonucleotide
gaagaagaagaagaagaagaagaagaagaa

SEQ ID NO: 42 - DNA, 36 bp, Artificial Sequence
  Description of Artificial Sequence: Synthetic oligonucleotide
gaagaagaagaagaagaagaagaagaagaagaagaa

SEQ ID NO: 43 - DNA, 30 bp, Artificial Sequence
  Description of Artificial Sequence: Synthetic oligonucleotide
ttcttcttcttcttcttcttcttcttcttc

SEQ ID NO: 44 - DNA, 17 bp, Artificial Sequence
  Description of Artificial Sequence: Synthetic oligonucleotide
aagaagaagaagaagaa

SEQ ID NO: 45 - DNA, 25 bp, Artificial Sequence
  Description of Artificial Sequence: Synthetic oligonucleotide
gaacctgcgattcacggagataagt

SEQ ID NO: 46 - DNA, 25 bp, Artificial Sequence
  Description of Artificial Sequence: Synthetic oligonucleotide
tccacctacaaaataatccaggatt

SEQ ID NO: 47 - DNA, 25 bp, Artificial Sequence
  Description of Artificial Sequence: Synthetic oligonucleotide
aactacagacagatacttaccagta

SEQ ID NO: 48 - DNA, 25 bp, Artificial Sequence
  Description of Artificial Sequence: Synthetic oligonucleotide
catgtcctcaggctactgaccgtaa

What is claimed:

1. An isolated nuclease-resistant oligonucleotide comprising a nucleic acid sequence that hybridizes to a complementary target nucleic acid sequence of a gene or gene product to modulate the expression of a component of a mismatch repair (MMR) complex, wherein the component of the MMR complex comprises exon 7 of MLH3 of MutLgamma, further wherein the isolated nuclease resistant oligonucleotide does not impact the total cellular ratios of MLH1 and its binding partners.

2. The nuclease-resistant oligonucleotide of claim 1, wherein MLH3 comprises SEQ ID NO: 1.

3. The nuclease-resistant oligonucleotide of claim 1, wherein the oligonucleotide directs skipping of exon 7 of MLH3.

4. The nuclease-resistant oligonucleotide of claim 1, wherein the oligonucleotide hybridizes to the target complementary nucleic acid sequence comprising SEQ ID NO: 2.

5. The nuclease-resistant oligonucleotide of claim 1, wherein the oligonucleotide is at least 80% identical to a nucleic acid sequence comprising SEQ ID NO: 3, SEQ ID NO: 4, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, or SEQ ID NO: 28.

6. The nuclease-resistant oligonucleotide of claim 1, wherein the oligonucleotide comprises one or more morpholino subunits, one or more locked nucleic acid subunits, one or more 2-O-methyl moieties, or one or more peptide moieties.

7. A pharmaceutical composition comprising a nuclease-resistant oligonucleotide 15 to 30 nucleotide bases in length targeted to a complementary nucleic acid sequence of exon 7 a gene encoding a MLH3 subunit of MutLgamma, wherein the oligonucleotide hybridizes with and modulates the expression of the human MutL subunit by at least 20%, wherein the oligonucleotide comprises at least one modification, and further wherein the nuclease resistant oligonucleotide does not impact the total cellular ratios of MLH1 and its binding partners.

8. The pharmaceutical composition of claim 7, wherein the modification comprises a phosphorothioate backbone, a phosphorodiamidate morpholino nucleotide, a charge-negative oligonucleotide, a charge-neutral oligonucleotide, a 2-aminoethylglycine functionalized nucleotide phosphorothioate backbone, a 5-methylcytosine nucleotide, a 2'-O-methoxyethyl sugar moiety, a locked nucleic acid subunit, an ethylene-bridged nucleic acid subunit, or a combination thereof.

9. An oligonucleotide complex for modulating the expression or activity of a gene or gene product encoding a component of a mismatch repair (MMR) system, the complex comprising a first oligonucleotide and a second oligonucleotide, wherein the first oligonucleotide comprises a sequence complementary to an acceptor region of exon 7 of a gene encoding a MLH3 subunit, and wherein the first oligonucleotide comprises a nuclease-resistant modification, and wherein the second oligonucleotide comprises a sequence complementary to a donor region of exon 7 of a gene encoding a MLH3 subunit, and wherein the second oligonucleotide comprises a nuclease-resistant modification.

10. An oligonucleotide complex for modulating the expression or activity of a gene or gene product encoding a component of a mismatch repair (MMR) system, the complex comprising a first oligonucleotide and a second oligonucleotide, wherein the first oligonucleotide comprises a sequence complementary to an acceptor region of exon 7 of a gene encoding a MLH3 subunit, and wherein the first oligonucleotide comprises a nuclease-resistant modification, and wherein the second oligonucleotide comprises a sequence complementary to a donor region of exon 7 of a gene encoding a MLH3 subunit.

11. An oligonucleotide complex for modulating the expression or activity of a gene or gene product encoding a component of a mismatch repair (MMR) system, the complex comprising a first oligonucleotide and a second oligonucleotide, wherein the first oligonucleotide comprises a sequence complementary to an acceptor region of exon 7 of a gene encoding a MLH3 subunit, and wherein the second oligonucleotide comprises a sequence complementary to a donor region of exon 7 of a gene encoding a MLH3 subunit, and wherein the second oligonucleotide comprises a nuclease-resistant modification.

12. The oligonucleotide complex of claim 9, 10, or 11, wherein the nuclease-resistant modification comprises one or more morpholino subunits, one or more locked nucleic acid subunits, one or more 2-O-methyl moieties, one or more peptide moieties, or a combination thereof.

13. The oligonucleotide complex of claim 9, 10, or 11, wherein the first or second oligonucleotide comprises a nucleic acid sequence having at least 90% identity to SEQ ID NO: 3 or SEQ ID NO: 4.

14. The composition of claim 7, wherein the oligonucleotide decreases the expression of the human MutL subunit by at least 20%.

15. The nuclease-resistant oligonucleotide of claim 1, wherein the oligonucleotide comprises a pharmaceutical composition administered to a subject in a pharmaceutically acceptable carrier.

\* \* \* \* \*